(12) United States Patent
Ross

(10) Patent No.: US 6,444,799 B1
(45) Date of Patent: Sep. 3, 2002

(54) P. GINGIVALIS POLYNUCLEOTIDES AND USES THEREOF

(75) Inventor: Bruce Carter Ross, Victoria (AU)

(73) Assignee: CSL Limited, Parkville (AU)

( * ) Notice: Subject to any disclaimer, the term of this patent is extended or adjusted under 35 U.S.C. 154(b) by 0 days.

(21) Appl. No.: 09/221,017

(22) Filed: Dec. 23, 1998

(30) Foreign Application Priority Data

| Dec. 31, 1997 | (AU) | PP1182 |
| Jan. 30, 1998 | (AU) | PP1546 |
| Apr. 9, 1998 | (AU) | PP2911 |
| May 22, 1998 | (AU) | PP3654 |
| Dec. 10, 1998 | (WO) | PCT/AU98/01023 |

(51) Int. Cl.$^7$ ............ C07H 21/02; C12Q 1/68
(52) U.S. Cl. ........ 536/23.1; 536/23.7; 536/24.1; 536/24.32; 435/6; 435/69.1; 435/320.1; 435/471; 435/476; 514/44
(58) Field of Search ........ 435/6, 69.1, 320.1, 435/471, 476; 536/23.1, 24.1, 23.7, 24.32; 514/44

(56) References Cited

PUBLICATIONS

AE000833, GENBANK, Nov. 15, 1997.*
B31729, GENBANK, Oct. 17, 1997.*
N97733, GENBANK, Nov. 18, 1996.*
AC004564, GENBANK, Nov. 2, 1998.*

Borodovsky, M. et al. (1994). "Intrinsic and Extrinsic Approaches for Detecting Genes in a Bacterial Genome," *Nucl. Acids Res.* 22, 4756–4767.

Donnelly et al. (1995). "Immunization with DNA," *J. Immunol. Meth.* 176, 145–152.

Fleischmann et al. (1995). "Whole–genome Random Sequencing and Assembly of Haemophilus inluenza," *Science* 269, 496–512.

Marmur, J. (1961). "A Procedure for the Isolation of Deoxyribonucleic Acid from Microorganisms," *J. Mol. Biol.* 3, 208–218.

* cited by examiner

*Primary Examiner*—Mary K. Zeman
(74) *Attorney, Agent, or Firm*—Morrison & Foerster LLP

(57) ABSTRACT

The present invention relates to isolated *Porphorymonas gingivalis* polynucleotides. The polynucleotides comprises a contiguous sequence of at least 20 nucleotides which is identical to a contiguous sequence of at least 20 nucleotides within a sequence selected from the group consisting of SEQ. ID. NO. 1 to SEQ. ID. NO. 1120 and sequences complementary thereto.

17 Claims, No Drawings

P. GINGIVALIS POLYNUCLEOTIDES AND USES THEREOF

FIELD OF THE INVENTION

The present invention relates to P. gingivalis polynucleotides and to the use of these polynucleotides in the production of nucleotide probes for detection of P. gingivalis. The polynucleotides may also be used in the production of recombinant P. gingivalis polypeptides. The polynucleotides and recombinant polypeptides can also be used in compositions for use in raising an immune response in a subject against P. gingivalis and treating or preventing or reducing the severity of the condition known as periodontitis.

BACKGROUND OF THE INVENTION

Periodontal diseases are bacterial-associated inflammatory diseases of the supporting tissues of the teeth and range from the relatively mild form of gingivitis, the non-specific, reversible inflammation of gingival tissue to the more aggressive forms of periodontitis which are characterised by the destruction of the tooth's supporting structures. Periodontitis is associated with a subgingival infection of a consortium of specific Gram-negative bacteria that leads to the destruction of the periodontium and is a major public health problem. One bacterium that has attracted considerable interest is P. gingivalis as the recovery of this microorganism from adult periodontitis lesions can be up to 50% of the subgingival anaerobically cultivable flora, whereas P. gingivalis is rarely recovered, and then in low numbers, from healthy sites. A proportional increase in the level of P. gingivalis in subgingival plaque has been associated with an increased severity of periodontitis and eradication of the microorganism from the cultivable subgingival microbial population is accompanied by resolution of the disease. The progression of periodontitis lesions in non-human primates has been demonstrated with the subgingival implantation of P. gingivalis. These findings in both animals and humans suggest a major role for P. gingivalis in the development of adult periodontitis.

P. gingivalis is a black-pigmented, anaerobic, asaccharolytic, proteolytic Gram-negative rod that obtains energy from the metabolism of specific amino acids. The microorganism has an absolute growth requirement for iron, preferentially in the form of haeme or its Fe(III) oxidation product haemin and when grown under conditions of excess haemin is highly virulent in experimental animals. A number of virulence factors have been implicated in the pathogenicity of P. gingivalis including the capsule, adhesins, cytotoxins and extracellular hydrolytic enzymes.

SUMMARY OF THE INVENTION

The present inventors have isolated P. gingivalis polynucleotides sequences which can be used to develop nucleotide probes specific for P. gingivalis. These probes are of particular use in the detection of P. gingivalis infection. Further the polynucleotides can be used for recombinant production of P. gingivalis polypeptides.

Accordingly, in a first aspect the present invention consists in an isolated polynucleotide of at least 20 nucleotides, the polynucleotide comprising a contiguous sequence of at least 20 nucleotides which is identical to a contiguous sequence of at least 20 nucleotides within a sequence selected from the group consisting of SEQ. ID. NO. 1 to SEQ. ID. NO. 1120 and sequences complementary thereto.

In a preferred embodiment of the present invention the polynucleotide is at least 30 nucleotides, preferably at least 50 nucleotides and more preferably at least 100 nucleotides.

In a further preferred embodiment the polynucleotide comprises a contiguous sequence of at least 30 nucleotides which is identical to a contiguous sequence of at least 30 nucleotides within a sequence selected from the group consisting of SEQ. ID. NO. 1 to SEQ. ID. NO. 1120 and sequences complementary thereto, preferably the polynucleotide comprises a contiguous sequence of at least 50 nucleotides which is identical to a contiguous sequence of at least 50 nucleotides within a sequence selected from the group consisting of SEQ. ID. NO. 1 to SEQ. ID. NO. 1120 and sequences complementary thereto, and more preferably the polynucleotide comprises a contiguous sequence of at least 100 nucleotides which is identical to a contiguous sequence of at least 100 nucleotides within a sequence selected from the group consisting of SEQ. ID. NO. 1 to SEQ. ID. NO. 1120 and sequences complementary thereto.

In a second aspect the present invention consists in an isolated polynucleotide, the polynucleotide comprising at least 20 nucleotides, the polynucleotide having a sequence which hybridises under stringent conditions to a sequence selected from the group consisting of SEQ. ID. NO. 1 to SEQ. ID. NO. 1120 and sequences complementary thereto.

It is preferred that the polynucleotide is at least 30 nucleotides, preferably at least 50 nucleotides, and more preferably at least 100 nucleotides.

It is also preferred that the polynucleotide is DNA.

In a preferred embodiment of the present invention the polynucleotide further comprises a detectable label. Non-limiting examples of labels which may be used include biotin, radio isotopes, fluorescent labels etc.

The present invention also provides method for detecting the presence of P. gingivalis nucleic acid in a sample comprising:

(a) contacting a sample with the polynucleotide of the present invention under conditions in which a hybrid can form between the polynucleotide and a P. gingivalis nucleic acid in the sample; and (b) detecting the hybrid formed in step (a), wherein detection of a hybrid indicates the presence of a P. gingivalis nucleic acid in the sample.

As will be readily appreciated by those skilled in the art the polynucleotides of the present invention can be used to produce P. gingivalis polypeptides. This may achieved using any of a number of methods well known in the art, however, this will typically involve the use of a recombinant expression vector comprising the DNA of the present invention operably linked to a transcription regulatory element. It is preferred that the DNA is operably linked to a transcription regulatory element. This recombinant expression can be used in the transformation of an appropriate cell.

The transformed cell can then be used to produce P. gingivalis polypeptides. This involves culturing the cell under conditions that permit expression of the polypeptide and recovering the polypeptide.

The nucleotides of the present invention can also be used to raise an immune response in an animal by DNA vaccination. Accordingly the present invention also provides a composition for use in raising an immune response directed against P. gingivalis in a subject, the composition comprising an effective amount of at least one DNA molecule of the present invention and a pharmaceutically acceptable carrier. It is preferred that the pharmaceutically acceptable carrier is an adjuvant.

DETAILED DESCRIPTION

Definitions

A purified or isolated polypeptide or a substantially pure preparation of a polypeptide are used interchangeably herein and, as used herein, mean a polypeptide that has been separated from other proteins, lipids, and nucleic acids with which it naturally occurs. Preferably, the polypeptide is also separated from substances, e.g., antibodies or gel matrix, e.g., polyacrylamide, which are used to purify it. Preferably, the polypeptide constitutes at least 10, 20, 50 70, 80 or 95% dry weight of the purified preparation. Preferably, the preparation contains: sufficient polypeptide to allow protein sequencing; at least 1, 10, or 100 mg of the polypeptide.

A purified preparation of cells refers to, in the case of plant or animal cells, an in vitro preparation of cells and not an entire intact plant or animal. In the case of cultured cells or microbial cells, it consists of a preparation of at least 10% and more preferably 50% of the subject cells.

A purified or isolated or a substantially pure nucleic acid, e.g., a substantially pure DNA, (are terms used interchangeably herein) is a nucleic acid which is one or both of the following: not immediately contiguous with both of the coding sequences with which it is immediately contiguous (i.e., one at the 5' end and one at the 3' end) in the naturally occurring genome of the organism from which the nucleic acid is derived; or which is substantially free of a nucleic acid with which it occurs in the organism from which the nucleic acid is derived. The term includes, for example, a recombinant DNA which is incorporated into a vector, e.g., into an autonomously replicating plasmid or virus, or into the genomic DNA of a prokaryote or eukaryote, or which exists as a separate molecule (e.g., a cDNA or a genomic DNA fragment produced by PCR or restriction endonuclease treatment) independent of other DNA sequences. Substantially pure DNA also includes a recombinant DNA which is part of a hybrid gene encoding additional *P. gingivalis* DNA sequence.

A "contig" as used herein is a nucleic acid representing a continuous stretch of genomic sequence of an organism.

An "open reading frame", also referred to herein as ORF, is a region of nucleic acid which encodes a polypeptide. This region may represent a portion of a coding sequence or a total sequence and can be determined from a stop to stop codon or from a start to stop codon.

As used herein, a "coding sequence" is a nucleic acid which is transcribed into messenger RNA and/or translated into a polypeptide when placed under the control of appropriate regulatory sequences. The boundaries of the coding sequence are determined by a translation start codon at the five prime terminus and a translation stop code at the three prime terminus. A coding sequence can include but is not limited to messenger RNA synthetic DNA, and recombinant nucleic acid sequences.

A "complement" of a nucleic acid as used herein refers to an anti-parallel or antisense sequence that participates in Watson-Crick base-pairing with the original sequence.

A "gene product" is a protein or structural RNA which is specifically encoded by a gene.

As used herein, the term "probe" refers to a nucleic acid, peptide or other chemical entity which specifically binds to a molecule of interest. Probes are often associated with or capable of associating with a label. A label is a chemical moiety capable of detection. Typical labels comprise dyes, radioisotopes, luminescent and chemiluminescent moieties, fluorophores, enzymes, precipitating agents, amplification sequences, and the like. Similarly, a nucleic acid, peptide or other chemical entity which specifically binds to a molecule of interest and immobilizes such molecule is referred herein as a "capture ligand". Capture ligands are typically associated with or capable of associating with a support such as nitro-cellulose, glass, nylon membranes, beads, particles and the like. The specificity of hybridization is dependent on conditions such as the base pair composition of the nucleotides, and the temperature and salt concentration of the reaction. These conditions are readily discernible to one of ordinary skill in the art using routine experimentation.

Homologous refers to the sequence similarity or sequence identity between two polypeptides or between two nucleic acid molecules. When a position in both of the two compared sequences is occupied by the same base or amino acid monomer subunit, e.g., if a position in each of two DNA molecules is occupied by adenine, then the molecules are homologous at that position. The percent of homology between two sequences is a function of the number of matching or homologous positions shared by the two sequences divided by the number of positions compared $\times 100$.

The terms peptides, proteins, and polypeptides are used interchangeably herein.

An "immunogenic component" as used herein is a moiety, such as an *P. gingivalis* polypeptide, analog or fragment thereof, that is capable of eliciting a humoral and/or cellular immune response in a host animal. An "antigenic component" as used herein is a moiety, such as *P. gingivalis* polypeptide, analog or fragment thereof, that is capable of binding to a specific antibody with sufficiently high affinity to form a detectable antigen-antibody complex.

As used herein, the term "cell-specific promoter" means a DNA sequence that serves as a promoter, i.e., regulates expression of a selected DNA sequence operably linked to the promoter, and which effects expression of the selected DNA sequence in specific cells of a tissue. The term also covers so-called "leaky" promoters, which regulate expression of a selected DNA primarily in one tissue, but cause expression in other tissues as well.

As used herein, the term "control sequence" refers to a nucleic acid having a base sequence which is recognized by the host organism to effect the expression of encoded sequences to which they are ligated. The nature of such control sequences differs depending upon the host organism; in prokaryotes, such control sequences generally include a promoter, ribosomal binding site, terminators, and in some cases operators; in eukaryotes, generally such control sequences include promoters, terminators and in some instances, enhancers. The term control sequence is intended to include at a minimum, all components whose presence is necessary for expression, and may also include additional components whose presence is advantageous, for example, leader sequences.

As used herein, the term "operably linked" refers to sequences joined or ligated to function in their intended manner. For example, a control sequence is operably linked to coding sequence by ligation in such a way that expression of the coding sequence is achieved under conditions compatible with the control sequence and host cell.

A "sample" as used herein refers to a biological sample, such as, for example, tissue or fluid isolated from an individual (including without limitation plasma, serum, cerebrospinal fluid, lymph, tears, saliva and tissue sections) or from in vitro cell culture constituents, as well as samples from the environment.

The practice of the invention will employ, unless otherwise indicated, conventional techniques of chemistry, molecular biology, microbiology, recombinant DNA, and immunology well known to those skilled in the art. Such techniques are described and explained throughout the literature in sources such as, J. Perbal, A Practical Guide to Molecular Cloning, John Wiley and Sons (1984), J. Sambrook et al., Molecular Cloning: A Laboratory Manual, Cold Spring Harbour Laboratory Press (1989), T. A. Brown (editor), Essential Molecular Biology: A Practical Approach, Volumes 1 and 2, IRL Press (1991), D. M. Glover and B. D. Hames (editors), DNA Cloning: A Practical Approach, Volumes 1–4, IRL Press (1995 and 1996), and F. M. Ausubel et al. (Editors), Current Protocols in Molecular Biology, Greene Pub. Associates and Wiley-Interscience (1988, including all updates until present). The disclosure of these texts are incorporated herein by reference.

Pharmaceutically Acceptable Carriers

The antibodies, polypeptides and DNA of the present invention can be included in compositions which include a carrier or diluent. These compositions include pharmaceutical compositions where the carrier or diluent will be pharmaceutically acceptable. Pharmaceutically acceptable carriers or diluents include those used in compositions suitable for oral, rectal, nasal, topical (including buccal and sublingual), vaginal, parenteral (including subcutaneous, intramuscular, intravenous, intradermal, intrathecal and epidural) administration. They are non-toxic to recipients at the dosages and concentrations employed. Representative examples of pharmaceutically acceptable carriers or diluents include, but are not limited to; water, isotonic solutions which are preferably buffered at a physiological pH (such as phosphate-buffered saline or Tris-buffered saline) and can also contain one or more of, mannitol, lactose, trehalose, dextrose, glycerol, ethanol or polypeptides (such as human serum albumin). The compositions may conveniently be presented in unit dosage form and may be prepared by any of the methods well known in the art of pharmacy.

Mutants, Variants and Homology—Nucleic Acids

Mutant polynucleotides will possess one or more mutations which are deletions, insertions, or substitutions of nucleotide residues. Mutants can be either naturally occurring (that is to say, isolated from a natural source) or synthetic (for example, by performing site-directed metagenesis on the DNA). It is thus apparent that polynucleotides of the invention can be either naturally occurring or recombinant (that is to say prepared using recombinant DNA techniques).

An allelic variant will be a variant that is naturally occurring within an individual organism.

Nucleotide sequences are homologous if they are related by divergence from a common ancestor. Consequently, a species homologue of the polynucleotide will be the equivalent polynucleotide which occurs naturally in another species. Within any one species a homologue may exist as numerous allelic variants, and these will be considered homologues of the polynucleotide. Allelic variants and species homologues can be obtained by following standard techniques known to those skilled in the art.

Adjuvants

"Adjuvant" means a composition comprised of one or more substances that enhances the immunogenicity and efficacy of a vaccine composition. Non-limiting examples of suitable adjuvants include squalane and squalene (or other oils of animal origin); block copolymers; detergents such as Tween®-80; Quil® A, mineral oils such as Drakeol or Marcol, vegetable oils such as peanut oil; Corynebacterium-derived adjuvants such as *Corynebacterium parvum*; Propionibacterium-derived adjuvants such as *Propionibacterium acne; Mycobacterium bovis* (Bacillus Calmetic and Guerinn or BCG); interleukins such as interleukin 2 and interleukin-12; monokines such as interleukin 1; tumour necrosis factor; interferons such as gamma interferon; combinations such as saponin-aluminium hydroxide or Quil-A aluminium hydroxide; liposomes; ISCOM adjuvant; mycobacterial cell wall extract; synthetic glycopeptides such as muramyl dipeptides or other derivatives; Avridine; Lipid A; dextran sulfate; DEAE-Dextran or DHAE-Dextran with aluminium phosphate; carboxypolymethylene such as Carbopol' EMA; acrylic copolymer emulsions such as Neocryl A640 (e.g. U.S. Pat. No. 5,047,238); vaccinia or animal posvirus proteins; sub-viral particle adjuvants such as cholera toxin, or mixtures thereof.

As used herein, stringent conditions are those that (1) employ low ionic strength and high temperature for washing, for example, 0.015 M NaCl/0.0015 M sodium citrate/0.1% NaDodSO4 at 50° C.; (2) employ during hybridisation a denaturing agent such as formamide, for example, 50% (vol/vol) formamide with 0.1% bovine serum albumin, 0.1% Ficoll, 0.1% polyvinylpyrrolidone, 50 mM sodium phosphate buffer at pH 6.5 with 750 mM NaCl, 75 mM sodium citrate at 42° C.; or (3) employ 50% formamide, 5×SSC (0.75 M NaCl, 0.075 M sodium citrate), 50 mM sodium phosphate (pH 6.8), 0.1% sodium pyrophosphate, 5×Denhardt's solution, sonicated salmon sperm DNA (50 μg/ml), 0.1% SDS and 10% dextran sulfate at 42° C. in 0.2×SSC and 0.1% SDS As will be understood the present invention includes within its scope DNA vaccination. Further information regarding DNA vaccination may be found in Donnelly et al, Journal of Immunological Methods 176(1994) 145–152, the disclosure of which is incorporated herein by reference. Throughout this specification the word "comprise", or variations such as "comprises" or "comprising", will be understood to imply the inclusion of a stated element or integer or group of elements or integers but not the exclusion of any other element or integer, or group of elements or integers.

Preparation of the *P. gingivalis* Library for Sequencing.

To determine the DNA sequence of *P. gingivalis* genomic DNA was isolated from *P. gingivalis* strain W50 (ATCC 53978) essentially by the method described by Mamur J. ( J. Mol. Biol. 3, 208–218, 1961). Cloning of DNA fragments was performed essentially as described by Fleischmann et al., (Science; 269, 496–512, 1995). Briefly, purified genomic DNA from *P. gingivalis* was nebulized to fragment the DNA and was treated with Bal31 nuclease to create blunt ends then run twice through preparative 1% agarose gels. DNA fragments of 1.6–2.0 kb were excised from the gel and the DNA recovered. This DNA was then ligated to the vector pUC18 (Smal digested and dephosphorylated; Pharmacia) and electrophoresed through a 1% preparative agarose gel. The fragment comprising linear vector plus one insert was excised, purified and this process repeated to reduce any vector without insert contamination. The recovered vector plus insert DNA was blunt-ended with T4 DNA polymerase, then a final ligation to produce circular DNA was performed. Aliquots of *Epicurian Coli* Electroporation-Competent Cells (Stratagene) were transformed with the ligated DNA and plated out on SOB agar antibiotic diffusion plates containing X-gal and incubated at 37° C. overnight. Colonies with inserts appeared white and those without inserts (vector alone) appeared blue. Plates were stored at 4° C. until the white clones were picked and expanded for the extraction of plasmid DNA for sequencing.

DNA Sequencing

Plasmid DNA was prepared by picking bacterial colonies into 1.5 ml of LB, TB or SOB broth supplemented with 50–100 ug/ml Ampicillin in 96 deep well plates. Plasmid DNA was isolated using the QIAprep Spin or QIAprep 96 Turbo miniprep kits (QIAGEN GmbH, Germany). DNA was eluted into a 96 well gridded array and stored at −20° C.

Sequencing reactions were performed using ABI PRISM Dye Terminator and ABI PRISM BIGDye Terminator Cycle Sequencing Ready Reaction kits with AmpliTaq DNA polymerase FS (PE Applied Biosystems, Foster City, Calif.) using the M13 Universal forward and reverse sequencing primers. Sequence reactions were conducted on either a Perkin-Elmer GeneAmp 9700 (PE Applied Biosystems) or Hybaid PCR Express (Hybaid, UK) thermal cyclers. Sequencing reactions were analysed on ABI PRISM 377 DNA sequencers (PE Applied Biosystems).

Raw trace data files from the ABI 377 sequencer were manually trimmed using Staden Pregap (Laboratory of Molecular Biology, Medical Research Council, UK) running on a Sun Microsystems computer. Trimmed files were assembled into contigs using Staden Gap v4.1 and exported as a consensus file in FastA format for analysis. The sequences obtained are set out below in the Sequence Listings.

As mentioned above the polynucleotides of the invention may be used in recombinant production of P. gingivalis polypeptides. If desired the ORFs within the sequences set out in the Sequence Listings may be predicted. Prediction of open reading frames within the sequences may be made using well known programs such as GeneMark (Borodovsky M, Rudd K E, and E V Koonin. (1994). "Intrinsic and extrinsic approaches for detecting genes in a bacterial genome." Nucleic Acids Res. 22:4756–4767).

While methods for the production of recombinant polypeptides are well known to those skilled in the art an illustrative protocol which may be used is set out hereunder. Cloning, Expression and Purification of Recombinant P. gingivalis Genes.

Oligonucleotides to the 5' and 3' regions of the sequence of interest may be used to amplify the sequence of interest from a preparation of P. gingivalis genomic DNA using a thermostable DNA polymerase or similar nucleic acid amplification enzyme and a thermal cycler or similar device. The PCR fragment is purified, and digested with appropriate restriction enzymes and ligated into the corresponding sites of a plasmid which may then be transformed into a host, such as E. coli. A resulting clone containing the correct insert is selected and induced for the expression of the recombinant protein. Expression of the recombinant protein may be determined by SDS-PAGE analysis and Western Blot using antisera or an anti-hexahistidine antibody that detects the hexahistidine tag that may be fused to the P. gingivalis recombinant protein. The recombinant protein may be purified by disruption of the E. coli cells by sonication. In the cells lysates, the recombinant protein may be soluble in non-denaturing aqueous solutions, or be solubilised from inclusion bodies by detergents such as Triton X100, NOG and sarkosyl, or by denaturants such as urea or guanidine. Alternatively, proteins may be purified from cell fractions using detergents such as Triton X114. Thereafter, the solubilised protein preparation is diluted in binding buffer and bound to a Nickel-nitrilotriacetic acid column. After washing, bound proteins may be eluted with 1M imidazole in elution buffer. Following purification, samples may be dialysed against denaturing or non-denaturing solutions containing one or more of the detergents or denaturants mentioned above to remove the imidazole. The solution is concentrated as required and stored at 4° C. until used. Purity and antigenicity may be assessed by SDS-PAGE and Western Blot using selected antisera and the protein concentration determined by routine assay.

The recombinant polypeptides may be used to raise antibodies in a suitable animal. These antibodies and the polypeptides may used in routine assays, such as ELISA and RIA, to detect P. gingivalis infection. In addition the polypeptides can be used to raise an immune response in a subject to protect against, or reduce the severity of P. gingivalis infection. The polypeptides may also be used therapeutically as may be the antibodies.

It will be appreciated by persons skilled in the art that numerous variations and/or modifications may be made to the invention as shown in the specific embodiments without departing from the spirit or scope of the invention as broadly described. The present embodiments are, therefore, to be considered in all respects as illustrative and not restrictive.

SEQUENCE LISTING (1120 sequences)

SEQ ID NO: 1 - DNA (genomic), 4774 bp, PORYPHYROMONAS GINGIVALIS; double-stranded, circular
  misc_feature 1...4774
  hypothetical: NO
  anti-sense: UNKNOWN
tgggctacctgacgatacccgtacaggcggaatacaatatgctcaaggacaggctgaagctgcgcggaggtctctatacgtccctgctgctggagagttccttccgcgtgatcatcgacggtacgatggtctatgacgatcccaagctgggaacagcgcagatggatctgcgcgaactgaacttctcggacaagataaagggagcggatttcggtgtcataataggagccgactattatttcgcgcgacagataggtgcgtttgccgatgtcacattcggcctgatccctctgacgggtacacacttcaaggctattccttaccggatgtataacgtcttcgcacgtatcggattttcctacagactcaattactgagccactacacacggatcgcctgtccggtcttcgttggctctttcaaaaactatcactctttcaacacctcgaagcatagtacaatacaaatacaatggaatcgataacccaaatatatcgcatcggctacggtccgagcagtagccacacgattggcccacgtcgggctgctgagatgtttctcgatcggaacccccgggcgacctctttccgtgttacgctatacggcagccttgctgccacgggcaaaggacacctcacggatgcagctatccttgccgtcttggaagcaaaggctccgaccgaaatcgtttggaaaccggagatcttccaaaattttcaccccaacggcatgctcttcgagagcttcgacaaagagggcaagcagctcgacgactggctcatctatagcatcggcggcggagtcttggccaacgaacacttcaacgaacagcgaggtcgcgaggtatatccgctcagcaagatggcagatattctcgacgaactgaacaggcgcggcctaagctattgggagtatgtggaagaaaacgaagatcccgatatatgggactatttggctgaggtctggtcggtaatgcggagcgccattcaggaggggctcgatgctgagggggtgctgccgggtggactgggcgttcgccggaaggcagccagctatctgattcgtgcgcaggggtattcgccgggtgtacgaagccgaggcaatgtatatgcctatgctttggctgtgagcgaacagaatgcatcgggtggcaagatcgtaacggcgccgacatgtgggtcgtgcggcgttgtaccggcggtactccaccacctccaacagactcgtgacttcagcgataagcgcatattgcgtgcactggctacggccggcctttttgctaatgtggtacgcaccaatgcttctatttcgggtgcagaagtcggctgtcagggcgaagtgggagtggcttgtgccatgggagcggcagccagcagccagctattcgggggtaccctgtcccaaatcgaatatgctgcagagatggctttggagcatcacctcggactgacctgcgaccctgtatgcggattggtgcaggtaccttgtatcgaacgaaatgcctttgcggcagcacgagctttggatgccaatacttatgccaatttcagcgatggcagacaccgcatttcgttcgatcaggtcgtggaagtgatgcgtcagacgggcaaggatttgccgagtctatataaggaaacctctcagggtggattggccatagtacactgctgatgaaaaggtgcgctttctctctgttcggaagaccgacaggctttcttctgattctccttctcgcatttcctgctctctatgcactgagtccgacagagggtagtccgcgtattcttttgcccggacgatctatttggcccatggatcgtgaatggaccttcaagataccttatctgggatcacgccccacgcattgggctatcaagcatttgcccgaaggatttacattcgattcccacgaaggaattattcgcggtaaggcttcttctcgcatcgtattcgaatttgaaatatcagcagccaacgaatcgggtgccgacagttgcatttggcaggtggaagtgagtcggtataatggattggctcccgttatgggttggagtacacgttggctgaaggagaaagaaataaacgagcagactattttggatgtggccgatgcgatgcaaagtaaaggactggttgcagccggatataaccatatcatcatagaaagccactggcaaacgtccgtacgtgatagcgacgggagaattaaggcggatcctttacgtttccccaatgggatcaaacatttggccgatgaactgcatcgtcgcggtatgcggctcggcctttcctccaatgcatctcctcttaacgttcatggcttgagtggtagttttgagaaagaggcgatagatgccgccacattctccgagtggggtgtggattttatcaaatacgactactgctgttcaccgcctatatccatcgttgcgcagcaacggtatggtgccatggggcgcgcacttgcggcaacgggacgtcctccgttcttctccgtatgcgaatggggtgaattgatgccctggtcttggggcataacggtgcgtgccggcagttggcgtacctctttcgacattcaagacaagtggaaagctggtcgatattctaaacgcgacaatggtatttgggatgcagcaatgatcaatttgcgctacgctcagcatgccaatcgtggccgcgcgatctccgatccggatctgctattgataggaagcccctccaacggttgtacagcggaagaataccatgcacaaatgcaaatgtgggcgatgatgcgcgctccgctggtctttgctgccgatccgcgctccgtatcggcggaggcggtagcactgctgacgcatcccgatctgattgcagtcgatcaggatgcttctttccgtaatatcgtggaggaacgtcgtgctgacggtacacatttgtggacacgtcagctgacgaaaggaacggccgtcttggttgtgaatgcaggagaaagcccgacgacaacgagcatcgcttcacgccccgactcatcatctgcgtgggacgtatcgcgagctgcttatgtgccgccgagtgacttgggacgaatcgtcctgtcgccgcacgcagcccgactgtttgttttcgaatagcagctctgcgccggttttttacttccgacgcttgcgctgtttggagtcgaacttgtcgtagaaacgtccttccgtcggtttctctttgcgacctttgtttttgcgtgaagtgggattttcactacgtcgcccgtcgaaatctttgcgacgagcggaaaagttcttatctccgccttttttccccccggcatagtctttcttggtatccgcatactctacatggatgcggcgaccatccacttcgtaccgattgagggtttctactacgttcttggcttcgaactcgtctacatcgaagaaagcgaatcggggcatcaggtcgatccgtccgatattgacacgccccgggatacaacggttgatcagctcgatcagtcggttgggaaacatttgatccatcttgccaaaattgatgaacagacgggtcatcccttcttctgcttcgccggctcctcgttttcggtttttacgatctcccgaaacctcgtctttttttctctcgaccacttcttccacgtcttcggcacgttggtaatagtcgagcatgcgattgaactccaatgccattacccgacgaatcaattcgtctttttcaatccattcgagcttcttgttcacttcgttcaagacagagtcgatggccgttgtgttctctatatccacacgttctatacgatcggccagattgaacagttgcttttcgcatatctctgctccggaagggatgcgtgcacgttcgatctgcttctgcatcgtgcgctctatattcttgattttgcctttctccttgacatggcagatggcgatcgaaagacctgttttccctgcacgagctgtacgaccgctgcggtgggtgtagctctctacatcatcgggaagaccgaagtgaatcacatgggtcagatcgttcacatccaatccgcgggcagccacatcggtggcaacgagcagttgaaggttgcggacgcgaaacttctgcatcacatagtcgcgctgagcctgactgagatcgccatgaagagaatccgcgttatagccgtcttgaatcagttgatcggcaatctcctgcgtttccttacgggtgcgacagaaaacaataccatagatattgggatagtagtcggcaattcgctttagcgcaagatatttatggcgcgccgagaccatgtagtatagatgcttgatattggcattgccctcattcttattgccgataacaatttccttggggtccttcatgtacgaagtggcgatcttggagatctctttgggcatcgtagccgaaaacaatagcagatggcgttcggatggaatatctgcgaggatttgctccagatcttctgcaaagcccatattgagcatttcatccgcttcatccaatactaccgtatgaatgtccgacaggctgacggcctcacggcgcatcaggtcgaggagacggccgggcgttgccacgacgatttgcacaccacggcgcaaggctctgatctgcgcatctataggcgtacctccgtaaacgggtaggatgtgcacatcggacaaatacttggaatagctgttcaagtcgtctgctatctgtagacacagttcgcgagtcgggcagagtaccaaagcctgcggtcgtcctcccgacaaatcaattttctggagcagcggaa

SEQ ID NO: 2 - DNA (genomic), 641 bp, PORYPHYROMONAS GINGIVALIS; double-stranded, circular
  misc_feature 1...641
  hypothetical: NO
  anti-sense: UNKNOWN
tcttccgctttttttggaatactcattcgcatcgaaagctctacagagcctcaaggatgcggagaggattagtttgacacccgctcaaagctattttgctgagcgggtgttgcgctttctgcttgcagtccaataaacctgatgcccttaccggcgtctatctaagcataaacgacaaaaacacattagtcaaactttaagaaaacattgtatgaacaaagtgtggaaatacgtgacgggagcctttggcatagcagccgtcagcgcagtagcatcggtggcaacagtggctgctttgggacccttccgagggtggaattcttcataaccgatggtacggaaaacgaattcggattcaagcagacatcttacacaacgacatccggagccttcgccgctctgcccaatttggtcggagctgcagaagcatcggtacacgccgtagtacacatcaaagtggagtccgagcagcgaatggactcttcagcagtacttcgatccgttctgaattcttcttcggaggcgaatccagaaactttcagcgtccccaaacacggcaggtagtaggctacggttcgggggtgatcatcatgcacagacggatatatcatcacgaataatcatgtagtaaagggagccaa

SEQ ID NO: 3 - DNA (genomic), 3613 bp, PORYPHYROMONAS GINGIVALIS; double-stranded, circular
  misc_feature 1...3613
  hypothetical: NO
  anti-sense: UNKNOWN
gacttctttaccccgctaaaagtaaccttactgatgcgaggacgttcagtgacaatgattttcagatagactttattgccgacatatttatccgcgatgattcgcacatttgagaagtagccctgacgcataattctattcacggcagcagacatggcatctccaggaatcaggacttcatcacctacagccaagcctgaaagattgcgcaagacaaagtcatcgaaagacctcattccctcgatctcaatagatgctatggtcttatgaataggcttggcataggatatttcagggctatatatatggatctccgtgaggggtcagatccgaggactgtcctttcaggatccctatgctggcgcagaagagagctgctacggcaataatctttttgtacatagtctttctcaaatgattcaatatttattttctctgagagcgatttgctcgctggtcttgccgaatcgacgctccctcgatgaatattcttctatggctgccttcagacagtcggcatcaaagtccggccaaagcgtatcggtaaaaaacaattccgtataggccatttgccacataagaaaattgctgatacgcttctctccacctgtacgaatgaagagatccggatccggaatgccggcggtggaaagatgatcagaaaccaaatcgacatttatatcttcaggctccacacttccatcccgaacctttcgagccaatctacggatgacatcggtcatttcccagcgagaactgtagctaagggccaaaaccaaagtcagccccgtgtttccggcagtctctcgaatacccttttctaacgattcacggacatcctcggggagccgactgaaatcgccgatagccaagaggcgaatgttattggtcatcaagtccagcatctcattcatgatagctgtaacgaaaaggcccatcagcgccctgacttcctcttccggacgattccaattctccgtactgaaggtgtaggctgtgagatattccacaccgcaaccggctgctgcacgcaaagctacgcgcagagcatccacaccggccgcatgtccttcgcatcgctctttccctcgtatctttgcccaacggccattaccatccatgaccaaagcgatatgcctcggcactataactgctgactggagcttgtctccatcaccttccatctatctcttttctatcaagatatttcacctaacgaccaatccaagagaggtctattcccttagaatgtttcgaggccctattgtttattacaaaaagtcttacgcaggccgaagtcatacgtaatcctaagcactaaggcccctgtagcatccttgtttttgacccaggagtcattgatcttatatggatcctcgagccaaacacttttatccgtcagcgcatccaaagcatcggtaagtaaccccgtgaaagaatactcgataccgacattgatccgcggtttaagcttatacttcactcccattcccgcagtaatcccgggagcaaaagccgaacctttagcacccgaagcaaaacccaaagacaacccggccgctacataaggagacagccgagctgtaccaagatacttatagccatcgctataagggagaaagttaaattcgcttctaacgtggagctgagtcaagccgaccttaaaatccgcttgagcaaaatcggggaagacattcccggacttatcggtatcgcctctcaatgtacgccaatccaacatggtactgaaagcccagcgaaaattataattgtaacgtccgaccaactccaaacctactccggatgaaccgaacaagcctctgtttgcatcgccaaaatactgagcagcaccaaaacctcctcctatttcatagagaaaatcctgagcagctatccggccgttacacactgcaaacaaagcaatggcggcacagatccgtgccgcatggttcttactaattgttttcattcagtttcaggatacccttccatattgaggaaaagaatgttcctgaagagctaacgcctcccaactgatatatattgtaagccccatcatcaaaagcacagacgaacgacaacggatagccggctgtgtagaaaggatcggccggcaacataatatcggcggctccacgtttccatgtgatgcccttatcagtcgaatatgccacagctactcgctttataccttcggcttgttctgtggcataatagtacaagttaccatccgatggagtttgcaccaaagcccctttttccattgatgcgggaatggctccggcagccaagtcaagtccaaaccaatcgtttccattgctcgtgatccaaacggaagtggcaggagcacccgtacgcgttacaccgccgactaaacggagcattggatgattgtttgctttatatagttgagtactgaaattgcgaacagggaaagtttcgggagcttgctcctgccaagaatggactccatcgatattggtggcaaagaacagagagccatctttttcagcaagtaatgccagtgtatgacttccctgtggccaaaccatggcacccagcagggcggtcacagggacttcagaggggagcaaactccagtttgtgaagtcatcgctttgataaataccggaatctgttagaatccaagcgcgtccatcttcagtcgcggctatctgcctacatgcaccggacaagccggaagacgatagtaaagtccaatgaacaggatttttcctgtcagatgaatacaacagcgtcttattacctgtggctgctaccaaataaaccctgtcagcatgtgttacaacatcgacaaaagaagcattgatatccggtaaagctactccatcgagcatatgccaaacaaacgtagtcggttgataatcataacgattgagggtaacagtatactttttcgttttctcgccactttcgtcgaaaaccattaaatgcaaggtatgacaatcgcgcaaccacaacgaatctttattatgccaatctttatactccccatcattaaccgctacttgcaacttttttgcagagagatccgtaacgagattcattaggacagaatctaaaaccgtgccataaggcatatatttcttattaacaattgtcccttttgcatgatcgatagagaaaaacactttttctaaatccggattcttcttagtagaaaggtagaatcggtggatttgcagatcaaccacattcacgtcttcgagatctaacttggactccttacaagagaccaaagctatacctgagcaaaaggagataaaaatccaaaagagatatcggatgaaatgtttcttgcacatacctataataattttgtgtacaaagataagatatctgccgacttatgtaacaattgcaggctatcgcatccagggcaaccgcatcaaaataaggatatctttgggattatgcatgtaacagatttttcaaggaggtaaaagatcctcgtgttgtaggtcgctgtaagtataagttaagcgacattttagttatcgccttggcgagttatctgtttggtggataggattatgagtcaatgcacgaactgggtttagagcgagaagaatcctttcgtccattggttgaa

SEQ ID NO: 4 - DNA (genomic), 588 bp, PORYPHYROMONAS GINGIVALIS; double-stranded, circular
  misc_feature 1...588
  hypothetical: NO
  anti-sense: UNKNOWN
agccgcacgattggaaaagaaactggagcaactcacagcctaacggcgcaagagcctgtgcttgagacgctgcagaagaccgggatgattctccggatcgcctgaggtcaatgtctgggaaagattcttttcggatacgatcagtagcacgtctcccacttgcaagtgcatacgccctttcggtacacgataagccctcgcctcttcgtaccaggatgacaagctcttcatcacgaagagaaagattcatcagcagatcgccatgggacagcatggaagcatccaccactctctcctccaacttggttcccgtctcttccggtatttccacaccgaacaggctacctattggcggcgaaggaatatccagtccgagccaacgtgctacctgggagatcgtactcccctgtacgagcagagagagtatggtaatgaagaagacgacattgaaaagctgatccgctccggggatattatcgatcatgggataggtggcaaagatgataggaacggctccgcgcaatccgacccagctgagaaaggtcttacccctgaatgatattttgcggaagggaatcaggcagaaat

SEQ ID NO: 5 - DNA (genomic), 600 bp, PORYPHYROMONAS GINGIVALIS; double-stranded, circular
  misc_feature 1...600
  hypothetical: NO
  anti-sense: UNKNOWN
gctttcatctctattctccttttttattctattgtgtttttttcatattcctcttcggacatagccgtttccgcatacaaggcttcctcttcccatccgagcatttccacaaactccccctccgcatcagccccgcgatcgagacaatactccaatagctccatggcgtaggccgtttcccggacggcttcgtcccgatcgagagcgatcccgttcctgttggacgaaagtcgtcccaccgtattcagctccaccgccacacctatggccagtgccaaagccacacaagctacagccccgtagcgtaccaaccgaagcgacaaccgccttgaaggatgccggacacgatcctcccaactcgccatcttttccaagagaactttgtccgaatcatcttccatngcccgtttcacgctcaggaagaccgatcaaagcccgcaaaagctgcaagtccgaatgatagggagccggatccggcaatcccttcagcaagcaatacagctccaactcctcttgcggaaaatggtaccggcataaaaactttncagtagccggtcgattttattctctcttacgcatcatcttatcacctcctagctt

SEQ ID NO: 6 - DNA (genomic), 483 bp, PORYPHYROMONAS GINGIVALIS; double-stranded, circular
  misc_feature 1...483
  hypothetical: NO
  anti-sense: UNKNOWN
aacacaaaactttagaagggagtcttacacttcgtcccatcgagtgtctatcctttaccggtagtttcatgagtggcaagaccgctgccctgaatgatgctcccatcaaaatcaatagcaaacagattatggccggagatttatacgacagatcccgctggagtgtaggaggtatgttccgttccaaatacttggatctgcgtagntgaaataccttcgaaggcaaagacgatgacatgattagtaagggcttttacgtcacaggggtaggacgattgttcaaaaacctcgatatcatcggatcatatgacttcatggatttgtacgaaaggcaacatgtctcataatattaccgccggccttcaagtactggttcttcccaaagtgtcgtttgcaggcacagtatgtattgagcaatccgaaaggcgagtacaacaacacacacgctctgctaacacaggtgcaggtagcattctgacagca

SEQ ID NO: 7 - DNA (genomic), 982 bp, PORYPHYROMONAS GINGIVALIS; double-stranded, circular
  misc_feature 1...982
  hypothetical: NO
  anti-sense: UNKNOWN
ggggatttggggcaagataagttactttgtagagcttgaatggcaaacatgggatttctgcctattttccaaaaatctgcatcgtcgattcttgaaacgtgttgagagccaacgggggcgcaaggagtttgttctggttggccacccgaagagcttcgtctccggggagagttttaattatcttatcgggcaacttaaaagcagctatcagttcttgagcatgacagagttgtatgatcagaggctaaagataggcacaaagaaaggcgtcaaggatactcataagcccgaaacacctgccccagaaggaccatctccagagggacctgaagctggtttgtaattagttcatagaagctcaccccagtagaggtagcgagttttgctggggtgagtgtctatctgttattgtttagtcattacgacccaatagatgggtattatcaaaactccatattagatatgcttaatgcaatttatttttaccgattgtctcattggctttatcgtcatcatatcccgatattgccaaagttaatcacattgctcatcttcctcatttataatagcaagatacctcctcaagctaagataggcaaaggatctaagttcggttatggagggataagtgttgtggtacatcatgactcggtgataggagaaaattgtagtattggtcacgttgttactataggaggaggtaattcgaagtatccaggagtccctgttataggaaataatgtccagattagccgaggaagtgtggtttttggcgggataaccattggtaataacgttgttataggagccaatacagtagttaattttcctgtcccagacaatgctgttgttgaaggcaatcctggtcgtattgtgcatattaaggaaagtacatgttagcatcattcctcaaacttaaaacctattgngaacaagaaggcttcaaaggttgggatccgtacgatggattgaactccagggt

SEQ ID NO: 8 - DNA (genomic), 6089 bp, PORYPHYROMONAS GINGIVALIS; double-stranded, circular
  misc_feature 1...6089
  hypothetical: NO
  anti-sense: UNKNOWN
agcagccggccggccaacggaaagcttcgccccccatggcggcacgaatcatttcgatagacacgtaagaagggctttggaaagacgagcgaccacgtagcttgataatgttggctccccccttcacgacacgctgtttcagttctgcccactgctcgttggtcagcttgtcggtaccgatcagatcggtcagaggcgttccgtttaccttggccgtgctggcgaaaacagccatctgctcgccatgacctccataagtacgcgtgttggtcacgagactttgtttgatgccgaagtgcttagccagttcgctttgcagacgtgtgctgtccaaaccggccaaagtagtcacctgcgaaggcttcagcccggagtagataagcgtaacaagaccggtgatgtcagccggattgaagatgatgatcacgtgcttacagtcgggacaatagctcttgatgtccttgcccagctgagcagcgatttcggcattgcccttgagcagatcctcgcgggtcataccctctttgcgcggagcaccgcccgaagaaactatatatttggcatctgtaagagcctctttgatgtcggatgtaaaagtcagattcaggccttcgaatccgcagtgacggatttcctctgccacgccttccaaacctactgcgaaaggatcatacaaacacaaattaggggtcagacgcatcattgcagctgtctgtgccatgttggaaccaatcataccggctgcaccgacaatggtcaatttctcttctgttaagtagctcataactgttccgttattaaaagattgcaaaaacctaattcggggatagcgactcttcttcgactttcccgatatatctatcagacaaatataagagtttcctaacaatatcctgtagacacgattaaaactgtttacgtgccaaaaatcagccactctacagtccgcaaaacgtggttcgagaaaattttcgttttggttcgggaagcaaaaaattctcgcgccacaacgaaaaaattctcgcgcctgtttttcaggattctcagaccgcaatccgagcatttcccgttcgtattttcgagaaagcagatcagctgacactcgcctaccggcccgaacatgcagggaggacaagcctcggtaaaaaacgatctacatggatgattgtgaaaattgcaaaagaaaacaggaaaaacgactatcttcggtatccgaactcactcacattctaatcgacactgcttatgcaaagtttttttgacagggaatttacgttcgaccgtactgcacgcctgtttttcatcatcctgttggttggaggcattatggccatagtcattggcttgagaggcatccttatacctttttgtctctcttggattcttgcctatgtgctgatgcctctggttcgttttgtccagtatcggctccattttcgctttcgctttctgtcggtgatcacggtgctggttttcatatcggcattgatcttttttgccattctctctttggttcctgctgtagaagaagaggtaagcaaaacaataaccctgctccagcagtaccgcatcgatgagaatttgctacagatgctgccggctccgatccgcaagtttctgtcagagagtggcagcatgaacgatctgttcaaaggtatctcttacgagaaattgatggagaatagcaaggagatattcggacagctcaataagctcgtctccggtacgatcagcttgttcagctatacgacgatcttcttcataggtgttttatacttcattttcatcctgttcgatttcgaaaaactgggcaaaggatttgtcaatcttttcccggtcggacaccgtattcgcgttaggagcatactcaaagaagtggacaagaatatgaacagctacttccgcggacaggccctgatcgccctttgtgtgggcatccttctttccatcggttacaagattatcgactttcctctgggagttacgctcggtctctttatcggtatgctgaatctgattccatacttacagatagtcggtttgatcccgattgttttcttgtcagtgcttaaggcggcacagacgggacagaatttcttcgttgttcttgccctcggtataggtgtgatgatgattgtccaagtaattcaagacacgattctgacccccaacatcatgggcaaaaggatgggcatgtctcctgcaatgattttgctttcgatttccatctgggggagcctgctcggctttttcggactgttcattgccctgccgctcaccatgtcgctttattccgtgtacaaacgctatgtgattcaggatcccaagttcatccgagaggagaatgaagagactatgcccaagaaggggctgtttagaaagcatagccgaaaggaggaaaaatgatttagcgcgcggatataaaggtctctctccgctgaacgctgattcgtttggggctgtgtcaaaattcggttttgtcgcagccccttttgggtgtgcaagaatgtgtaaagtacaaggtactaagactgaggtagaaaggagcgaacttacaagtacgcgactgaagccgaatgtcgcaagcaacgcagtaatttgcgcatgatgacactccgtcataatcgtccttatgccgtttcgttgtcatacacaatcattcaaggtaacaaacagacaaacttggcattggctcctgcttgagcggattgccccgtgattattttatgtcccaatatcattacctttgttcactaatgtaaataaggacaagcaagacggattgatatgaacgaaaataagaacagcggcatagaggaaaagaagagtcttaacttcatcgaacaaattgtggaatcagacctgtccgaagggaagaatgacggtcgaatccagacacgtttccctccggaacccaacggctatctccatatcggccatgccaaagctatctgcatagacttcgggatagctcagcgatacgggggcgtctgcaacctgcgcttcgacgataccaatccggtgaaagaggacgtggagtacgtggatgccatcagagaagatatagaatggcttggcttccactggggcaatatctactatgcttccgactattttcaggaattgtacgacttcgccgagcgactgatccgcgagggacatgcctatgtggacgaacagactgccgagcagatcgccgtacagaaaggtagcccgactgtgcccggcacggccagtccgttccgcgaccgtccggcagaagagagcctcgacctcttccgtcgaatgaatgtcggagagttcgaagaaggcgccatgaccctacgtgccaagatcgatatggcttcgtccaatatgcacttccgagatccgattatctatcgcatcatcaagcatccgcatcatcgtacaggcaacgaatggaatgtctacccgatgtacgactttgctcacggccagagcgattatttcgaaggagtcacgcattcgatctgcaccctcgaattcgaggtgcatcgtcccctttacaattactttatcgagctgctcagaaaagacagctatgcacctcgtcagatagagttcaaccgcctgaatctgacctatacgatgatgagcaagcgcaagctgctccagctcgtcaaagacgggctggtatcgggctgggacgatccccgtatgcctactttgtgcggctatcgccgtcgtggctatacaccggagtcgatccgcaacttcatagacaaaataggctataccaagtacgatggcattatagacgtagcccttctggagcatgctgttcgggaggacttgaataaacgtgccacaagggtttccggtgtaatcgatccgatcaaactggtgatcacgaactatcccgaggacaagacggaagagatggcagccgtgaacaatccggaagatgagtctgccggcgtacatacgattactttcgctcgcgaactgtacatagagaaggaggatttcatggaggatgctcccaagaaatatttccgaatgacgcccgggcaggaagtacgcttgaagagttcttacatagtccgttgtacgggatgcaaaaaggacgaggacggaaacgtcgtggaagtatatgccgaatacgatccgctgacgctgtccggtatgcctgagagcaaccgcaaagtaaagggtaccatccattgggtatcggcacagcacagtctgccggcagaggtacgactgtacgatcgtctcttcactgacgaaaacccgtcggacatcaaagacaagacactggccgagatgctgaacccggattctctcaaggtgctaaaaaactgccgagtagagcctttcctcgcggatgccgctccgggatcgcacttccagttccagcgcataggttacttcacggtggatccggatagtcgtccgggggcattggttttcaaccgcacggtttcgctgaaagattcttggcagaaagcccaaaagaacgcataaaggacattatttatctcactcgcacctatgggatttattcagtggtgcctcgcgcacctgaactattggactatcatgtttttgatggccatcgagagttcgtttattccgttcccgtcagagattattgtgcccccggctgcatggatggctgccacggggcaaaatggactgaacgttttcctcgttatcctgttcgccaccatcggtgccggaataggagctgccgtaaactatatactgtctctattgctcggtcgccctatcgtctacgcgtttgccaacagtaagctcgggcatttgtgtctgatcaacgaagaagaaagtacgatatgcagagcgatatttcgacaagaacggagctgtctccacactggtaggacgtttgattcctgccgtcagacagttaatttccataccggcaggactggcacgcatgaagtttctgccctttatctcttacaccatgctcggagccggcatttggaactgcatattggcggcaataggctataatctggccaaagtgcccggcatagaaacgcaggagcaacttttggagaaagtcaataagtacagccacgaaatcgggttctccataatgggagtcgtcgtagtagtactcctgataatgttttacaagaaaaagcgacgttcggcacggaaagggaactaaacttctcactcaggattcaaccaatagaaaaaacagataagaaaataatcattgctatggctcttacaaaaacttcaaaactctattacaaagtccacgactacatccttattattctgggatgctccatctatgcttttgcgtggacgggcttcatcctttcccaaggaattaccacgggaggattggccggtatctccactctgatcaagatcgccacgggtattccggctgcgataccgtacaatatcatcaatctgggattagcggtactcgctctgatcttcttgggatggcgtttcatggtcaagacggtcataagcgttgtcataatggccattatcatcccgataggtgaagagtatctggtcgtcacggagatcgtcaatggcgtaaaagtttttacgcctcttctactgccgaatgaaccggccttagctctggtgatcggctccattcttagcggtctgggtattgcgatagtattctccgtgaactccagtacgggcggtaccgatattatcgtagccatcatgaacaagtacaagaacatgtcgttcggacgcgccattctactggtggactgtaccattattttgtgctcgtatctggtcaatgtctacatcgccggcaagtcaccttccgacgctttcaacctgcttatctattcggccatagaggttatcctcgtatctacagtcttgggattggtatctcaattcgaatagacagtccgtgcaattcctcatcttcagtctcaaaaacgaagagctcagtaatgccattcaagagcgcatcaaaagggggtgtaccctgctggatgcgacaggaggctattccggccaaccttgtaaagttcttgtggtcgttgcacgcaagacacaaagcctatccatccacagaatcattcaggagatcgaccccg

SEQ ID NO: 9 - DNA (genomic), 703 bp, PORYPHYROMONAS GINGIVALIS; double-stranded, circular
  misc_feature 1...703
  hypothetical: NO
  anti-sense: UNKNOWN
cctgagccacacactggtctataatggcattggacacttcggccagacgatatacgttggcctcgcgagcacgatagtcacctcctttgatcgtatcgtagaagagtcgataaacggagtcgccgtcgttctggtagttcttggcggcattgatacctccctgtgcagcgatggagtgcgcacggcgaggagaatcctgtatgcagaagttaagcacattgaagcccatctcgccgaaagaagcagcagccgaagcaccggccaggccggtaccgaccacgataatatccagacgacgtttgttggccgggttcaccagcttctgatgatccttatagttggtccacttgtctttcagcgggccggcgggtattttggaatttattgtagccatagtgagaatactttgaattagggtgtactatcaaccgatgaatgcctgacaagcaaatactatcaggaccaaagcgaaaccgcctaccaatacggtagaaaccacattagagatgcacttgacacgattcatccagatggtattgttccatcccaaggtctgcagtgcactccagaatccatgtgtcaggtggaaccacaaagcaatcagccatacggcatagagcaccacgtagatcggttggttgaatgtgtagcggatcagctctgctcccttggccggatggtcgaaaccatcaataccgaatcc

SEQ ID NO: 10 - DNA (genomic), 728 bp, PORYPHYROMONAS GINGIVALIS; double-stranded, circular
  misc_feature 1...728
  hypothetical: NO
  anti-sense: UNKNOWN
ggcagtagcctgttcggcagcanccgtggcctcacgatcgcgcaggttttccaccataccctcgtattcgagtgctnccacacgattggccagctctatttcgcgtaccttatccgttgtacctgctccgatgctatccaaatacctttcgctctggagctctgctcttcggcggtcgttctgcatggctttgaccttgagttcgcgtcgcttggcgttgagttctccgcggagttgtacttcctgccgatgcagttgggtctgcttcatccgcagttcgtcctgcaatttctcgaactccgtgcgcacggactgcaagtccagttccaacaagggttcacctcggtgtaccgaatcgcctgcatgcttgagcacagctatcagacgcgcctgcaccggcgaagtgatgatctcctcgaaagccggcaccacttcgccggaagccgaggtagcgatctgcacttctcctttgtccacccgccccaaacgcagagaggctgcggatatggagccttggatggaggagagcaaccaccatccgcctaagaagagaaggactgccgaagctgttatgattgaggtaaccgtctttgcttttcacgttgagccgttcggcgaaacttgtctgtcatgaatcggtttcttttttccggtgcgagcctttgttgctcgccggcttccgaagagcaaatgccatgccaaacaaatccctggccttattaatcagg

SEQ ID NO: 11 - DNA (genomic), 772 bp, PORYPHYROMONAS GINGIVALIS; double-stranded, circular
  misc_feature 1...772
  hypothetical: NO
  anti-sense: UNKNOWN
ggttgtccgtaaacgtggaaccgtgtctggcacgtgtattggtcgtagggaaaccgacaatatcgggcggagagtacacaggcgatgtttcctgctatgtcattgatgtagtaccacaaaggatataccccttgcgccatttggccaaactctccagtggcactaatgaagcctatggagacaattcgcctcttgctgaccgttatgcctcaagttgggcagaggaatcgatagccgccggtgtagcatacaacaacgtctatgggtatgtcaaggcagacatgtttgacaatcctgtggcagcaaccaagatgcaggagaaaaagacggacttcaatctgaaccaagtagcgatctatacaaaagaatcgaccgtaaatcctaaaaactactttacggcttatgtgccgagagtagtcttgcgtgcaaaatacgttcctcatggcatccccggcgtgaagccggatgaaggctggatcgaatttcagggtagaaagatgagtctggagcagttcaaaaaatacgtagacaatccggtttctgccggtatggctctggccgacagcatcaagaaggcgaaagctgacaattcattggtctatacaggtggattcgtcagtcatggaatacagttctattacaaatcgcagaattattatgccatccctattcgccatttcgatgatgaaaaagctcctaacaaagattcctacgggcgtttcggcctcgtacgaaacaatgagtatatcctctcggtaaagtccattacagg

SEQ ID NO: 12 - DNA (genomic), 561 bp, PORYPHYROMONAS GINGIVALIS; double-stranded, circular
  misc_feature 1...561
  hypothetical: NO
  anti-sense: UNKNOWN
acgaactgaaaagcgttttgctgaaagacctctatgacaatggcgagaaaatcattcgaaaccagcagnggcagatcgattcgctccgaaatgtattaaacttctacaaccgtttctcttcgatggagagtgagatagcccaagagctgcaagtgattttcccctctatcaattcggctatgctggtaccttcgtccggagtggcacagggtagggattccgttttgctcgtcgtggtgcgtccgaaagaccggataagccagtcggaaataaacaagctaagcacatggatggctacgcgtaccaagaccaagaaagtgcgccttatcatagacaataatcataggtaacaaccataaacagtaatgcaaatgaaattaaaaagtattcttctcggagcagccctgctgttgggtgcttaaggggtagccaaagccgacaaaggcatgtggctcctcaacgaactcaatcaggagaatctggatcgaatgcgtgagctcggctttacctcccgtggattcgctctacagtttcgacaagccgtccatggcatgcccgtgg

SEQ ID NO: 13 - DNA (genomic), 679 bp, PORYPHYROMONAS GINGIVALIS; double-stranded, circular
  misc_feature 1...679
  hypothetical: NO
  anti-sense: UNKNOWN
attacaaggaaacctcttgatcgtaagcggatcggcagacgacaatgttcatcttcagaacacgatgctttttacagaggcactggttcaggccaatatccccttcgacatggctatctatatggacaagaaccatagtatataccggggggaatacccgctatcatctctatactcgcaaagcaaagtttttgttcgcaatcttttantacagnttttctcagttgcttgatggggcgagtggcgaagggggtttttgttcacttgctccgttcgacagtggtctctaatagctctttgttgaaaaaactatggcgcaacacgtcaagaaacccgaatggttgaaaatacgtcttggtgggaatgagaagtttaccgagactaaaagcattgtcgagggacattgtctgcatacgatctgtacaagtggcaaatgccccaatatgggagagtgctggagtagggggactgctaccttcatgatcggtggtgatatctgtacacgtgcctgtcgattttgcaacactttgacggggcgtcccaaaccgctcaatgaagcagaacctactcacgtcgcattgagtatcaaactgatggggcttaaccatgctgtggtgacgagcgttgaccgcgatgacttgcccgattatggtgccgcacactgggttaagaccattca

SEQ ID NO: 14 - DNA (genomic), 7608 bp, PORYPHYROMONAS GINGIVALIS; double-stranded, circular
  misc_feature 1...7608
  hypothetical: NO
  anti-sense: UNKNOWN
gtaccaaaactcctgcaatttttttgtttccatatatgaagtattatgtgtntgttaagtcatcaatgtttatatcagatggtaatgcgtcatcgtttttaacgctgttcaaatctcgttgtttctcattctctgcagaatacgcatgtatgcaattagaagattctttgcaacagacaaatctatttctccggtaatggtcttctccatgaaaagcaatgcctcttttggagcttcattctttgataatcttcctgctaaaatgaggatttgagcaatgagagcatctcctcgctttgctgcataaatactgctctccatcatcactaaaaatttagctttttcttcaaagatatttcctggagagattcatgaatcggcttcttcttttgctgcaaaatatgcaacttggttgagcccaactaacccaatatctgggcagatgcaataacgtcagtttttaatttctccattttggtaaaaaacatttgaaataatattttgatttgatttggatattctactctggagctaaaaaagtcatcgaaagctgccttattgaatgattgtaaaaaacgattggtgaaaaagtcaaatcggtcataatcggtatccccataaactcttttttcttttttatagagccgacttataaaataagctatccactatagagtgtagtttcccctcttttgctagatctattatataatgatgaaacgtaaatggaattgcattgccgtatgtaatcagatacaaggttgatcctttcaatgaatctagcaccttttgagcaagagttgaaaattctgcatgcttggcaaattctcctatagcccctaacaacgcaattgctcccattctgtcacttttgggtgaattagggaaattccctcgaaagatttttggacgatgaggaattcctttattatctatgtttcctaacattgcctctcctgataaatgagtgatttgcattttgtcaaagagagctatgaaatcgaccatttgattgagtgggatatcaggaatgatgcaaaaattatctttcccgacttgcaatgcaggctttaagggcgttagtgtagtaataagtccatatgtttgttcttcaacagatatttttgcagagcctcgcccagtatctttttcgccaaaagtcaggtattctccggatatcgggatattagacatgctcacattgtcttttttgagtaagccttctcgttcattgtctttgcctaaatagtctatttcaagaaatttagatgcttttgtccaaactttttgggcgtgcatgtctttcgtgacaatatgtggggagagaaatattccgttctttgtgtttccatcttttcttttgacaaaagagaaacgggcctttgatcctggggaaaaaggctcctgggcttggatcctaaaagaggaaaccgctttttcaatgctgaatctcaattcttttggagttagcctttccctctctgatacatgattatcatacagagttattgcacatccatatcggatataataatgatttgtattcatgacttttcttcaaggtaaagtgtaacccaaccttcgctgttgcccaaataccccatgttttgttgggggagtgtttttgatagcaaatcaaccagttgaggatccattttaattacacattcataatttccttcaaaaaataaatattccctatttgtaggagtggtgtagaagaaagatattctatcaatattttctcgtaaaaatttttcttctttttgatctgtcttttcttctgtttccaaggttctctcattttcacacataaatctaaatttatccataactagcgtatagtcaatattttgagtgcctccgaaatggattttccctgcatctttcctcctaaaagcacgcttccataaatcgttataaaaaaacgggctatcggtggaaacaatgcgaacactatctaactcgaagaaatcggataataatggtatgaagatcgagcggatagtgggagggatgtatcctttttttgttttttttcttatattctttatctcttttgttattatttctcggtctttacgactaaaatgccaccccaaaacattctcgaacaaaccacaaagaatatgcttgtcagggtacaaaagagccttgtagtatgatcccggaagttcgcttaccatagagattggagcgtgtggttcaatgtggagctttatcgacgcagataaatccgggtcttttcccagtatggatagatctatatttttcatattatatttcattttatggcaccgaagccgatgccggttgagttgccgatgcccgcgttccatgcgaacagcttggtctcggcattccctattatgcggatagggcaccaactggctttgtttttcactccccggtaatcgataagcatcaccttggctttcccctgatcggggacaaaggatgcggtggcagtagggtcatcgattcctaccgcctgaagttttttgcgaagattttctgtcagtagggcattggctgcttcgtccgtatagactatatggtcgaacccattgtcctcgcgccaacgcttcagcaggatagggctggcaggaaagaaaatttcgcgatcggtcatgtcgggatcttcgataacggtcacttcccggacgcagaggcttttgaacatttcgggatcttgacgaatccctgccagcatacgtctgataagctccggatcatgagcactgacaaacatattggcccaatcggcaaagagaatactgttgagttctgatacgagtttgcccccattgagacgagaaaatgaataggagatacttttgccgtgcatatcgttttctccgagccatttttgaagagtgccgacgagcaaatgttggtgagaaaaagagactaatgaatcgtctgccttgatggatagttctattcgcatgtggttatagcttataatatatttaatggcctaaagttactctaaaagctgtaattaatacgtatttttttatgcttatttgcgaggaaatcggatatatagcatccatcgttccgaggaattttgcgaaaaccgcactgaaaatagaaaaggggcgagggcggggtataaaatacgaaccgaaaatgctccgattgtggtgcgtgttttctgaaaaaccggaacaagaagtttttcgttgtggcgcgagaattttttatttctcgaaccaaaacgaaaaagtttacgcgccacgtttttcgggggcgcagacacagagaagtcggttcgtgaatgaaccgggtataacgaggtgtgccttatcgctttatgtgaacctttaacaagagatcaagacagccgtagcaagtctgtctttcaggtatttcatcttgtgaatagagaagggataatatcctctttcggagtattgggtaagtgggcgattcgaggaggttcgatcataagctcctatgattagagatacttcggttttgagataatgttagcgagacccgaatagagccaatcatgaataaaaggtttatcccaagatggagattcctacatggaactctctccgattgcgatagaaagggagtaggatattaacgcgatagcatatccttcatcaccgattgcagcattactttggccgctatagcgcgttggtcggcaagtggggcttcgtgtccatagacaatcttgtcgccggcaaaatcgtagatggtagttccttcagaagtcgccatagcctactaaaccggggaaggagaaataagcgaaatgggggctgtttctccgaaaaacatctttggagaatacgaattcatcatgagtaagccctaattgggccagcagcgtggcaggcaaatcggantgcgncactacctcttcgaagcgtatcggtcgtaagatggctcctcctgcccacagcatcacaatcccatagcggccgggctgatcgggcatagcttggtcggcaggatagggataaccatgatcggaaacggctatgatgagtgtattcttccattgaggagactgctgcataccacgtatatagtcgccaaagcagctgtccgtatagaagacgctattgagatacggatcaggatgatgctgagaagggacatcgaatggttcatggctggaaagtgtgaggaagctgtagaagtaaggtttcttttctttctccaatcgccgacaatcgtccaataggcgtgggaaactgatatgatccggcgtaccccatttgctcaacctcgttttgaacggaaagctgctaacgtccgttacctcgtcatatccagtgccgtataggtagctacggacatttgtaaagtcagcatctcctccgtacaggtggtgggtgctatagccgacggtgcgcaatgaagcagctatgcccggcaggttgcgcaccttattggggtatttgatgatggatgaattcggctgcgaagggtagccactgagcgtggctactgtgcctctgtctgttcgaaagctgcttgcgaaggcttggctaaagagaatcccattctgtgccagcgaatcaatgcagggtgtatgccccggggtaccaccgaggcatcccacggcattagccgagaagctctccagcaggatcagtacaatgttcggcctatctgtactcaatatcctctctgtgctatcagaagccgattctcttacttcgcttccatccgaacaaccgtataaacgaagttgctcgaaagctttgatacagtcttcttctgacaaaaattgatagttcgaatagtcttcttcgctatgcatgcaggtatatagaaaactgaaaacaggattgacggcagcctgattgtgtagctgcttgggactgtgaaagacggatccgacattgagcgtagccactcccactcctcctctgatcaggaggaataggaaagctccacccacaaccggtttccatatgccggcgatatgcggatgtgcaactacttttgtcggaaagtacctacggtgaaatcgatgtagaacgaaagccggtatgcaaacgaatacaaccgtgatcaagagaccgatcaagagttgcggtgctgtaacactggccatggcttcctgtggctggcgtagataaaaaagtggtgtggcatcgaggcggaaaccccagtacccgaaaagcatcagatccgccgtgtagatcagcccgacaaagaagcttatgagtgtgtaataatgcttaagaatttgtctcagtattcgcccgattttcttttctccccagccggcaatggcattgatgccggcgaacaatagaggaagtactgtcaggtaagctgctacggctgcatcgtgcctgagtccatacaggaaaatggccgcaatatctccgctggaagtgcctatcccggcaagccggccagagtacacgagcaggaatatgactttctgaaagaggaaatagagcagaaatagaacaaatactcctattacgtagcagaaaccgcttcttttccgaaacaaaagctctcctcgttcgaacaacgtcttcatatgtcaggctgtcggacgctttccgcgcaagaagaaggggcgtgctatcgcccacacaatccccagcaggagtagtgccagagctgtcttggctatagcttctgtgatgtgcaggctcttcggatcaaaacgaaattctattttatgacgcccggcaggaacctccagtgcacggagtatatagttggcacgaatgatcggtacagcttggttatcgatagtcgctgtccagccatgaggatagtatatctcggaaaatatgcccagcatgggttgtgtgctcacagcttcgtacacctgtctgttcggagcatattctttcagacttatagaggcagtgctatcagtcagagccggtagccttttgagcgattcggaagagaatcgttcgtccacgacagcgatgtcacgcgtcagtcgattgctgtccaaagccatcatttcctcattggcatttcctacccagcggatactgccggccggccatgccggaccgtaagcgtccggattcgacatgggagagggccggttgttttctccggggactatgatatacttggtgttgagcatattgactacttcgcgattgcctttgctcagttggtgttcgatcaaatcctgataacgctggagtttggcagcgtggtatccaccgatgctccggtgccagcggctcgtggtggcatcattataagtgtccacggtgagattcagaacgcggtacccgagcgacttgtctgcaaggatttgcttgtctgcttctgtcagaggtgcagcacgttggctgacgagttcgggatctatgaaatgctcatcgttcagatagcgtttgtccaccgtccatagatcgaccagcgtgatcacggccaaagataccagtagagcagttgctttgagtctcttttgaaagaagagccacaacaggatgccgcatacaaccaatatgccgaagctacgccatgcatcagaagctaatatgcccgagcgaacattcacgagggtagtcttgatagctgctgcttcagggtgacctgctgcttcttggaacatagcttcctcctgcccgctcagcaaaccgagcagggagggcacaagggcaaaaagaagcgatgccccaagggtcagaagtgtagctgcaacccaagcagtacgttcgcgcttaaggaggggttttccctctttgattatttccaccaaagccataacggccaaagccggaatcgtaaattcggcgatcacaaggatggacgataccgtgcgaaacttatcgtacagaggaaaatggtcgatgaagaagctcgtcagccacatcatattatgcccccaagagagtagaatagacaggatggtggctgccagcaaagcccacttgacaggccctttgacgataaaacaacccaagacaaagagaaagagaacgaaagctcctacatatacaggccctgccgtgaatggttggtctccccagtagcgattcatacgagctatcgcctgagcataggatggattcacggtttccatcaccttttcgtcataacccaagtaaccggaggatcctcctttaatatcggggataaggagcgaccaagtctcacctataccataactccattgtgtgatataggccttgtccagtccgcttttattctcatgcgtcacttgatccgtgggtgctccgctctgcttgagcgtcagttcgctacctccacgcatggtctctttgccgtattggtaggtgtggaagaggttggtactattcacagctatacccaccagacctgctatgacgactactgccgaggaaaggaagaagtgtcggattcgttttgttcgaatggcttctgccaagaaagccaacaccatgaaaaacatgacgaacaggaagtaatagctcatctgtacatgattagccaagacttgcaaagccgtgaaaaaagccatcacgctaccgcctgccaaccacctcccattgtagatccagatcataccggcaagagtaggaggaataaaacacatagctgtcagcttccatatatgtccggccataatcagaatcaggaagtaggaagaaaaggccc

SEQ ID NO: 15 - DNA (genomic), 686 bp, PORYPHYROMONAS GINGIVALIS; double-stranded, circular
  misc_feature 1...686
  hypothetical: NO
  anti-sense: UNKNOWN
ggctgcaagtatcgcgtccggatcagtgcacaacggtatggtttcattcccatcgaatgctgttgttttacccggtcatcagggagacgatttgggtggttcacagctgatgtattcccgtttggcagaaagcaaactttcgcccaacgagctgtcgcgtatcctctactcccacaagcagatgaatcagcagttcgacaggaagcaaaaggaacgattactatccatacaggcaaagctgttttcctcctacgacaaggaacaacaacctgcttatcgcactttcgagcagtatatgcagtgggaaaacatccctaagtatatgctcaacagccagcaatcatggcgattcttcggattagatacggtttgtatgcttctcgataaggaattgcttgactttgcctactctcttcccttcgaataccgctacggaaagcgtatctatgatgatatttgtcgtgaactgtatggcgagaaaggcatttctttttcggacgatttgaacctgcatggcattatctcttctcctgtttaccgactcaaacgatctctaaagcctttgcttcgaccatttataccccgtccttcgatttggaaaggcgatattatcggttttggaacggatcatgcaacctgtattaccgacaggtagagcaaggacgacgtttccacccgacatctat

SEQ ID NO: 16 - DNA (genomic), 643 bp, PORYPHYROMONAS GINGIVALIS; double-stranded, circular
  misc_feature 1...643
  hypothetical: NO
  anti-sense: UNKNOWN
cgaggtagccctgctttgtctgtccactcattcatatcattgagggaagctccatcgaagataggtgtagcaaatttgacattcatcttgcgtcccgcccaggcaagtaccgcttcgaatatctgtcccaggttcatacgggagggtacaccaagagggtttaggcatatgtctaccggagtaccgtctgcgaggaacggcatatcctcttgacgcacgattttggacacaatacctttatttccatgacgtccggccatcttgtcgccaacttggatcttccgtttcttggctatatagactttggccatttgaacaataccggcaggcagttcgtccccgatggtctcatctaatttgcgacgccgtagttcagcttcaatctccttggagtgcttcagataattcaccgcaacagccttaatcaactcgttcgtatgtgcatcatttgtccaatcacttaattggatcacattgaaatcaagagcttcaagatcttttttggcgaatttgctgccggccttaatcaactcaacattcaagtagtcctttacgccacagcaggttttgcctttggtcaagttctggtagcttgtcgatcagacgcttcatgaagtggtgctgccttttcgcgtatgtttcg

SEQ ID NO: 17 - DNA (genomic), 464 bp, PORYPHYROMONAS GINGIVALIS; double-stranded, circular
  misc_feature 1...464
  hypothetical: NO
  anti-sense: UNKNOWN
catccccggcaatcccagccacatataccagaacataggggctacaactccatcgctcagattctccgacaaagtctccaaagctgccgtcctgacttcctgcgccgacagagcagccgtatcgcgccctacgattcgcgtcacctgtttgcgcccttcttcaagcgaacgatcgactgcttcgaataccatacgtacttcacgaataagggtagtacctgccaaacagaagaaaatggccgatagccaaaataagagaagccacagcaaatgcaacagcaatccggaaaaaatcgtccagcaaaatggtataaacacagacaaaaacaagtcccaagaggatcaatagggtcaaaagaaaaacggcaacgatatagaacaccgacatgaaggcgcctttcacctgcggtagtttcctttattcaatctttctctccgatgcaatcatgcgaccgaagccgact

SEQ ID NO: 18 - DNA (genomic), 751 bp, PORYPHYROMONAS GINGIVALIS; double-stranded, circular
  misc_feature 1...751
  hypothetical: NO
  anti-sense: UNKNOWN
gccgtctggttgaaaagggcaagatgtctgccgatgagcagcaagccgttatggctcgtatccgtacgacgatggacttcaatgacctgaaagatgccggtatcgtgattgaagcgattgccgaagaaatggaaataaagaaacaggccctcagtgctgtggcggaagtggtaagcgagcaatgtatcatcgctaccaatacatcttcattgagtatcacagctttggcaacccgaactccctaccccatctcgtgtgatcggaatgcacttcttcaatcccgttcccgtgatgaaactggtagaagttatcagtgcccagcaaacttcggacgaagtgatgaagcaggtactggacttgtgcgaaatgctcaagaaaacagccgtacgcgtgaacgaagctccgggtttcgtcgtaaaccgtcttctcataccgatgatcaacgaaggtatcggagcctatgccgacggtgtggccagcatagaggaaatagatcaggccatgatgctcggtgccaatcacccgatgggccctttggctttgggcgattttatcggtttggatgtctgtctggctatcatggaggtattattcaccgaatttggtgatgccaaatatcgtcctcatcctttgcttcgcaagatggttcgtgcaggacagcttggccgcaagaccggcaaaggcttctacgactatagcaaataagtcgtttttctcacttatcggacttatccgaaaataattgagggtg

SEQ ID NO: 19 - DNA (genomic), 660 bp, PORYPHYROMONAS GINGIVALIS; double-stranded, circular
  misc_feature 1...660
  hypothetical: NO
  anti-sense: UNKNOWN
ggacttatgtgttgaacgaaagcttcgatacgcaaacgcttcctaacggctggacaatgatcgatgctgatggtgatggtcacaattggctatctacaataaacgtttacaacactgctactcatacaggtgacggtgctatgtttagcaaatcatggacagctagcagtggtgcaaaaattgatttgagtcctgacaactatttggtaactcctaagtttacggttcctgagaatggtaaactttcttattgggtttcatctcaagagccttggactaatgagcattatggagtgttcttgtccacaaccggaaacgaggctgcaaactttacgataaagctgctggaagaaaccctcggatccggcaaacctgctccgatgaacttggtgaagagtgaaggagtaaaggctccggcaccttatcaggaaagaaccatcgatctctctgcctatgccggacaacaggtgtacttggcattccgtcatttcggctgtacaggtatattccgtctttatcttgatgacgtggctgtttctggtgaaggttcttccaacgactacacgtacacggtatatcgtgacaatgttgttatcgcccagaatctcacggcaacgacattcaatcaggaaaatgtagctccggccagtacaactactg

SEQ ID NO: 20 - DNA (genomic), 586 bp, PORYPHYROMONAS GINGIVALIS; double-stranded, circular
  misc_feature 1...586
  hypothetical: NO
  anti-sense: UNKNOWN
cggcaacgcttttcatcgtattagggacgctgaccaaactgtatggtatcgttggcttggctttcttcccgtttgtgaaaagaaaaggccgctatttggcttggctttttgcatggttcggtctgatcggtatcttgccgatgttgtttggaggaggttcttatgcccttgagcagtatatgaattggtttgctagccttggcacgaagaatggggagaatctgttctccctgtatcaaaacgtttccctgctcgggatggttaggaaaatgaccggtattgccggctactccgacttgctgttgttagtccccggacttatcctattcgctcttcctttcctccgattcagtcagtacaaggctccactctttcggatgagcatattggcttcgactctgcttttcaccgttttattcagtaccggtagcgaatcgagtacttatatcatagcgttgttgggtgtcggtatctggttcatacatcgccccaaagggaaacccgaccggctggatattacactcttagtcggaacactattcctctcctctttatcgccgaccgatctgtccctgcggctcttcgc

SEQ ID NO: 21 - DNA (genomic), 2843 bp, PORYPHYROMONAS GINGIVALIS; double-stranded, circular
  misc_feature 1...2843
  hypothetical: NO
  anti-sense: UNKNOWN
aggctatctgccactcataccgccgatgcgtgccgtagagcgatcgagaccgatatgagtattcagcgatgagtcctcgtcccgatggaagtttgtgagcagcgatataaatccgtttttcgctcctcgcttgtcctgtcccatatccagtcgggcacggatgctgtcgtttgccactgatgctttcaggttgaggtctcgtgtcgtggcatcgccattcacatacaagtcggaccgacagatgagttcggccttgccggtggatgagttcaaggtcacctccgtatcccgtagctctttgttcatagtcatgagcctgtcggtacgaatgtgcagatcgaggcttcgaagcaattcggaataggctgccctgatcttgatagaatccgcttcggccaaaggcaaccggaagaagctgcacacttccttgggcaaagagccgtccaacgccaaacgcagacggacatcctcagtcggcactcttgcctgcgacctatggcccgcaagtgcaggaagatgtgcgccaaccactccttcgagcatcgaaggcagcttggacaatgtgaactcgccatgcagtgctccctcaaggaaaggcgaactgagggtaatggagctatgtcgctccacccttgccatagccagtttcacattgtgcagatgcagttctttgtcggaggtttgccaatccagggtatctattcgtatcgttcctgtcagatcgtcaatacgactcccgaccaattctccggaagaaatcagaagagcatcggccgatggcagtccgaagccgggcaaaagtcgatcgggacgaagtttgtgcgctgtcagattccattcgaaccgggaagaactcgaagagaaaggcagcccctctccggcagaggatagccggatatggccattggggtcgttcatattcaggatgcctgaccactgccccttgtcggcctgtaagtcgatcgtcaggtcctcataggtatagcctcggaaagtcaggtgcgacacgcgtccctccacacttcccgagaggagattgccggcagccagtcgggccttcatcttcaggtcgaacgccacatgttcaggccaatcgtgccggtctgccatgagcttgagttccagtctttcggtagtcgcatgagcatctacatcggcaagtcgccagagagaatcgaggccgatgctgccctgtatggtcaaagctccggcatccgtctccacacgagttttcaggcgcagatcgtccagccggccgttagcggctgccataatatcgatagcacccaagtggcgcatttgagtggggagcttatcgggaaaaagacgttctgccagcatgtaggtccggactccgagcttaagctcatccaaccggagtctgacatgcatccgttccttttttcctatttctgccaaccctatgcctgcctgcaaggtcagttcatcgccatagttcatactgatttcaggcagaaccgcttcgccggaagcgactgtcagctcgggcacagagagattcaatatatcatccatcgtatcgagtgccgggagcaaacctttcaggtcggagggacggatccgtccgcccaagtccgtcacccttatggcaggcaaggcagagttttcgggcgagagaacacagtatccggagaccataccgatgtgactattcggcaaagagatatgaagacgagccactcccaaagtgtcgccacgaagactgacatcggcatgcagttctttgagatcgagaccggtatttttttcgagaaaagaaagatggcgcagctgagctttcagtcccgtactgtccgcttggaaaagacgtactttggcattcaagtcgagcaatcccaatgtgtcggattgggtcttgtacaatcccgaagcagagagccggcagttcctgagcaagatggtattgatattgagtcgtagccggctcggctcttccggattcttacttttcagagcatccagaaggaactgaatgttcagagccgtatcgggacgcgaacgatatacatcgagttcgcctttgaacagacgagcagaggagaagctcagacggcctttcaaaagagggagcagatccagccccccggtcaaacgttcggctgacaccgcaggacgacgggcacgatcgaagatgacaatatcgtcgatctccatttgtcgccaccaaccaatgctgatgtgcccgatgcggacatgcgttccgagtgctttggatagctcggtctgcacacgtccggcgacggaacgcttcactgacggaatttgcaaaatcagattgggaaggatcaacaggcaaaaagcaacagtcagcacggccacgacgatccatttggagcgacgcatagccttgcgataacgacggataaaccggatgagaccggctgacagttttttcctttgactcacgcagacaactttactttcaagtggcaaagatacttacattccttagcttaaaagtcgaaaaagagatccgccgaagctcccccaaaagaggaatcccgtaaaaaccgaaaatctgtaatatactgtatgaaaagtctaacaaaatccctatcggcactcccgataaagaaaacacgagcggcaagacacaaaaaaacggaactgaaaaatccgaaatagtcgttcggtgatcaaaaaattctcgctcgtctttttttcgcttttggttcgagatttggaaaaaagacgaaccgtaaatccgaaatcatggcgcgagtttttcccgatttttcgttcgctttttgtctgttgcgactgctctatcagtagccgataacagattttatcacaaatgggtattcggagttttgtatcga

SEQ ID NO: 22 - DNA (genomic), 739 bp, PORYPHYROMONAS GINGIVALIS; double-stranded, circular
  misc_feature 1...739
  hypothetical: NO
  anti-sense: UNKNOWN
ccgaatccaaagtctcaagctctgcaatgattgctttcttgctcttcaggttttcgcattcttcggagcgcatatctccctgttcggcttttttacgtttgaagaatgcatcgcatgcagtcgtaaaacgcttccatatctcatcactataccgatgaggaacggctccgatggttttccatttcttttggagttcggccaagcgagtagaggtttctttccagtcggaactctcctgaaggctctccgcttcttctaccatggccagcttcttcttgtagttatcggtcagctcttcacgtttgcctttgaagaaagctgttttcttattgaaataatcgtcacatgctgcgcggaaacgctcgtagatcttctcattgtcgcttctgcgagcatagcctatagtcttccacttggcctgaatctctagtacggccttcgtttgctcgtcccatttggccagcgagttcagaccggaggtatctatcgcttccatttcttcacaaagcaatgttttcgcagccagattctcctgctcgcgcatcttttgcttttcgaagtgttcctgatacttcttattgatagcaagtagaagcagccttgaatctcgcccacacctcttcgcggagttcgcgagctaccggtcccaattcgcgccattgatgatgcagtcttgcagtaccctgaaagaatggatgacatccgcattctcagtcagcacttcggcctgatggatcaa

SEQ ID NO: 23 - DNA (genomic), 2922 bp, PORYPHYROMONAS GINGIVALIS; double-stranded, circular
  misc_feature 1...2922
  hypothetical: NO
  anti-sense: UNKNOWN
attgttttgtgtgtttatggtatgatcaatgacacaaaatgatggcacgacaaggaaaatcatccaacgagaagaggtctcattcagggacgtcatgtcaacgaatcgatacaggaaagcccggaatgtatttttgacccaagtcgatatgcttacatgagaggatactatggtctcctatgagaggatactatggtcttacacgagaggatactatggtctcatacgagaggatactatggtctcacataagaggatactatggtctcacatgagagaatactatggtctcctatgagaggatactatggtcttacacgagaggatactatggtctcatatgagaggatactatgctctcacatgagaggatactatggtcttacacgagaggatactatggtctcatatgagaggatattatggtctcacatgagaggatactatgatctattgatggaagatgctatctgctctgtgtcggatggcaggttcggggagtgggaggttccgtgcgagctgttaaaccgatagatgagattgtcacacggcattttccgggagatttcgttgtcaattgactgtttttcagtgtctgtatatagacataaagtatcaaatcaagagtcgtttgcttggcttgtcgggcttatgaatttgtcctgaataaatagaacagggtgaagagaagggtgagccgattggggtgtagctcgcaatgagggaaaagcaaatgtcgtggtcagcctctggcagagcgttcggcgatggctgtctcttctatgatacttcgagccatttccacaccttgtgagatacgatgtgccatacctattcccccatgcatattgccacccaaatgcaagcccggccagcgcatttccatccgccggatgatgtcctgccgaagttccgtatcggcgtagtattgcggtatggcatggcggtggcgtgagatgtgcagcagatccggcttacaggtgtgaggtatgcgcagcatatcgcgtagctcttccattgcaatcgtgctgatctcctcgtcggaaaggtctatgagcgaagcatttcgcaccccacccatgaatatggaatagagtgcgcccccttcaggtgctctgccacggaaacagtccgaagggaacaggatgccgaggatgcgacgattttccctcgaagggatcaggcacccgaaagccggcaggtgtgtggcaacatttcggcggaaccctacggcaacctctatcatgggtgcataatagagctgctcgaacacggctgattcatccgcagggaagtggtcgaacagtgtggggatatggtgcgctgccaccgtactcaccaagtggcggcaaggaatggtgtgctcctcttccgaagcatccgtataggtaaggccgaaggtgtgtgctcccgggtgattgatgtatcggatttgcgtttccgtcaggatgtgttcgcgtccgatgtagtcggccaaagcttcgaccagaagaccgagtcccccttgtacggaaaagaccttgcgcgaggctttgcggtcgcgttcgctttgcggctgtcgggcttttcgaacggcacccagtacgaagctgccgtatcgctgctccagatcgtatagtttgggcagggcaaagcgagtaaccagttggtcgggatctcctgcataaatacctccgaggaaaggatcgactgcgtagtccacaaaacttttgcccagccggcgacgagccaaggctccgaccgtctcattgggttgtccgcctctccggcggaagggttcgccgaggatacgccatttgtcccacagggaaaagagaggagtagcgactgcctcggcgatgttccttggaaggggatacagtttgttgcctttccatatcagacggttagaggccgcaggagtggctatctcaggttccaatccgagcagttcgaatagctcggccacttccggagaggagatcgtgccggtattcggccctgtctcgaacacgaacccgtcctctctgtaggtgcgtatctgtccgccgatatgagcagctcgctccaaaccagaacaggcctgccggcaagctctgaggaaagcggctgtggtcagtccggtgagcccggctcctatgatgacggtcagatgatccatgaatcaggcctccccaccttcaaaggcaagagcatagaaacgcatctgcttgagcatggagacgaggccgttggagcgtgtcggcgagagatgatcttgcaaccctacttcgcgaatgaagtagagatcggacgaaacgatgtctttcggtttctggtcgttcagtatccgtagtagcagagccactatccctttgacgatgagggcatcgctatcggcgcggtagtgcaccttgccatcttgcagggaggctgctatccatacgcgactctggcaaccttcgataatgttctccggcaccttatctgcagcatccagttcgggtagggcactgcccatatcgatcagcagttgataacgatccatccaatcatcgaaagcggagaattcctcgatgatctgatcctgtatttcgtttatacttggcatgggataagctaatgagtgaatagtcagtgtgaagcggctttcacctgttcgtccaaatatcgaatgacggtttcgcccacggcatcgagtacatttttgtcgatgatctgcatattgtccctctgggtatgccagtggtcgccgaagccatgttcgttcttggacgagtaattgataatatcgatgcaagggatccctaaattcttgatcacaggtacatgatcatctgtcagagcgcctccgtcggcttggatgaagtagttgccatatcctaatgcggctgccgtctgccatacggcagagatcaaccccggggcatagctcttggagaagtactcccaatagaatgtagc

SEQ ID NO: 24 - DNA (genomic), 642 bp, PORYPHYROMONAS GINGIVALIS; double-stranded, circular
  misc_feature 1...642
  hypothetical: NO
  anti-sense: UNKNOWN
aaagtccaaggaagagttgtctgcttttctcggctgtgagcatatcgagagctgcaaatgcttcgtcaagcaggagcaattgcgggcgttggagaaatactcgtgccagtgccacacgctgacgttgccctccgcttagatccttcggataccgatgcaatatgtccgacaagccgagggtgtgtacaatgctctcaaactccggcatctctatggcttcctttcgcagggtatatggaagtacgatattctcatgcactcgtttccatggcaaaagcccatattgctggggaactattcctatggaaaaagatttcggattcagaggtttcccatcgaatagcacttcgccctcatactctgtcagtacacctgccaaaacgtgcaggagtgttgatttgccacagcccgaaggtcccgttatggcaaaaatctctcctttgggaatattcagtgaaagaccgtccaatgctttcacttccgtactcccgtggcgatatgtaacggccagattgcgaatagagatcatttgcctaatggaggaatctgcgtttcgtccgtctcttgattatgccggactttacggatcagatccttgccggttagtcgctcgggaccaatttcttggcatgtacccagtcg

SEQ ID NO: 25 - DNA (genomic), 948 bp, PORYPHYROMONAS GINGIVALIS; double-stranded, circular
  misc_feature 1...948
  hypothetical: NO
  anti-sense: UNKNOWN
gtgctgatgacgttagccgtttactcatttatgcctctgatccggacgaaacagatctcattgtgacgcgagtgttcgatcgcctttcggaaacactctacgtcggggaacaacgactgaccatcaatacggctacagaactgaatccgatgattatggattggctctctgccttggacaccaatgttgctatcctgctgacactgatgggattggtcggaggcttcacgatgatagccggtctgattgttttggtcatggacaaaacgcagtttatcggcatgctcaaagctttaggctgtgctgaagggtcgcttcgccgcatattcctctatctggctatgatgctcgttggtcgtggtatgatctggggcaatgttttggctcttatactctgcctcctgcagcaacatttccgctggttgcgtctcctcgatcctgatatttactacatggactatgtgcctgttcaagtggactggctcgtatggattctcgttaatttgggtaccctcctcgttaccttcttgatgctccttgctccatcgcatattatttcgagaatttcccccgtcaaagcccttcgcttcgagtaatcgctcaccagggaatagggtaggtcatctgtccattcgagaccattacacaataacccttctaccccctcttattggtcgagatcagggcaatcgcatttgaactgttaacacacttataaacctaactaacgattgctacactcggttatcaaacaagtacgaattaatggggcctttgcacaataagcaggcacttttgttcattcttcttattgtgtgtcaggcgactatttggtacacgccgaatttccacaggtggaaatttactcccctttaatgagtgcccctttgagacatccaacgacatgaccggcaacagcacttgtgctcctccaatcatcgccttgct

SEQ ID NO: 26 - DNA (genomic), 4130 bp, PORYPHYROMONAS GINGIVALIS; double-stranded, circular
  misc_feature 1...4130
  hypothetical: NO
  anti-sense: UNKNOWN
ggcaacgtcctccgcagtgccgaaaacacctgcattgcccgatatacctccgaggcatgcagcagcttcgtcgtccacggtaccgcggacgatgcttttacgtagaaatttgtcgttctgtgccggtgcaatgcgcgaaacggaatatttatcgagtggaagataaccgagcgaaccggctccgatggggcggaatatacgttcttcgacaaagacgttcaagctcttgcccgatactttttccacaatttgctgtagcaggataaaccccagatccgaatacttgtagcgtccgactccattgcgaggggtagaagcgatggtattgaggacaatttctttgacctctttcgatagatacagattggaagaaaaacgaaacggatagtccggccgaaattgcccggaaaccaaatcggagcgaaatccgaagaatggattgccccacatattggtatctactcgaacccatcccgaactccgccggggagagagcaacttgccgtccaaactgctactgtctatcagagattcgtagaaattgatcgatggccgaaggcctgcttcatgaagtagaagctgctgtacggtgatgtctttgaggtctgttcgggcaaaacgaggcaatagcgttccgagccggtcggagagcttcaattttccatcctgaaccaatagcatcacagccggagtagtggctacgaccttggtgacggatgccaagtcgtagatggtggaagaagacaccttgcctccacgtgccgatccgtcgagagtgccgaagcttttgtcatataccaccttgtctcgatggacagcgaggatacgacaaccggggaaagccccttgccttagggcttctttcgctatgcggtctaccgccggcatcgggatgaggccggacgacaattcggtcggcggcatcatgttcgctgtcggatcaagtgtcctcctcttcctgaacgaccgggatcccaccgcccgaggataccacaactctgtcccgaatcttggaggctgccattcgagcagcctcctttacgtttcatatgccacgactatagcccgagctttgtccatagccgccggaatcctatcggctacatagggcgatgtgaagaagacgatggcagtgtggttttgttccgtcagccggtggagaaacgttcctgcccagtccggctgtgtatgtcgaactgtgacgatcacagcatcgtaccccttgagtttggagagcaactcttgtgtacgtgtactgttgctgcccttggcataggaatagcagtccttgctcgtaagccccagctcttgtgtaaaagtattggaggctgcaccatctagattgacgcatgcaatacggtttccctccgagagggggaggaagtgcttcttgtttttgagaatcgtaatggatgcctgccaaagatcttccgacatccgttccgcttcacggctgtttacctgtcgtaccacttcctctgccggtagctccttggatattcccttacaaatgatgagcgcatacttgaaggccagaattttgcgacatttctcgtccagcaattctttgcttatcgttctgtcttccactgcggccagcacctcggagaaagtcttgaccgggtccaccggaccgaggaggatgtcattgccggccaatatggcacggacggagatcggttgagaaccggctgtctgtactccctgcatggccagtccgtccgtaaagatcagccccttgaaacccatttcctgccgaagcagatcggtgcagatggcatgactgagggaggagggcgtatttttctttgcttccaaagccggaacattgaggtgagcggtcatcactccgctgaggccggctcggaaaaactccttgaaggggaacaattcagtattctccaattcctctcgggaggcaaagaccgtgggcaaggtcttgtgcgagtcctctgtggtattgccgtgtccggggaaatgcttggccacggccatcactcctccgtcctccaatccttgtgcataggcaatccctctttctgctactcggcgtgggttgtcgccgaagctgcgcgtgccgataacagggttcttcggattgttgttcacgtccagcaccggagcaaaattgatatgaatccccatcagccggcattggcgcgctacctcccgaccatagttgtagaggagctgattgtctttttggtgtcccaagcccatattgcgagggaagcgtggggcatctttcagacgcatgtgcaaaccccactcaccgtccagtgctatgaggagaggggtgccggctgcttcctgcaagcggcgagtcatcgtgtattgctccgagagtgtacccttttggaagagtatgcccccgatgtggcaggtgcgcaccagctgttcggcttgctttactttttcttcctgtaaagagggatagacgatcggcatgagcagctggcctactttttcctccgtgctcatagccttcatgcggtcgtcaacccagcgtttgacatctttgctctcgactcccccgaagaggagaaagggatagtctttggactgctgggcatgcatggcacccatgttcgtgcgggccggtgccgtagctgtgtacagcaccgagagagagagtattgtgatggcggagaaaagaaatcgtttcataccctacaaatgtacataaaaatggtggccgaatccgagccttcccttctacaagaaaaaggaaggagacggacaaaagaagctttgcttccgttgtcgtctccttcgctcgaaagagagtaaaaggtagagaaagttgttatgcttgttcttgtacgatgatctcgccatcgcgagcagagagcgtaagcgtctgccctttctcgatctgtccggagaggataagatccgtgaggcgatcctccacttcgttctggagtgtgcgcttgagcggtcgtgctccgtattggaggtcgtatcccttcgtcgctatcacatccttggcttcatcggtaaggacgaggtcgtatccggcacgatggatgcgcgccaagacggctttaagctctatgtccaccatccggcgaatctccgtcttgcccagttggtcgaagaggatgatatcgtccaaacggttgagaaattcggggctgaacgtcttgttcagagctttttggatcacggaacggctatgctccttgttcgcttcctcgtctttttccgaacggaacccgataccctgcccgaagtctttgagctggcgtgtacccacgttggaggtgatgatgatcacggtgttcttgaaattcacgcgccgtcccagactgtcggtcagctgaccttcgtccatcacctgtaagagcagattgaagacatcggcatgcgccttttcgatctcatccaagagaaccacggaatagggtttgcgtcttacgcgctccgtcagttggccgccttcttcatagcccacatatcccggaggggcacccacgagacgcgaaacggagaacttctccatatactcgctcatatccaccctgatcatggcattctcatcctcgaacaggtattcggcgagcttcttggccaaataggtcttgcctacccccgtggggccgaggaaaaggaaagaaccgatcggtttcttttcattgcgaagtcccagacgattgcgctggatggcatgcaccatcttttcgatggctgtgtcctgacctactactttggtcttgagatcatctgccatcgtgcgcagacgttcgccttcgcccgtgctcagccgctcagccggaacgcctgtcatcaacgccactacatgcgccactacattctcgtccaccgtctcgcggtgcttggacatctgctcttcccattttttcttctcttccgctatctgctgctgagtgcgccgctcctgatcgcggaaggaggcagccagttcgtagttctgagcctttacggccgagagcttgttctctcgcaccgatgccaattcggcctccagtatctcgatttctttcggagccaccacattggtgatatggacgctcgcgccggcctcgtccatggcatctatcgccttatctgggaagaaacgatcggatacatagcgatcggtcagttccactgccgctttgatcgct

SEQ ID NO: 27 - DNA (genomic), 5295 bp, PORYPHYROMONAS GINGIVALIS; double-stranded, circular
  misc_feature 1...5295
  hypothetical: NO
  anti-sense: UNKNOWN
tgctgctgaccgaatttggcaagtcgctgcccaagggtgaggccgagcgcattcgcaagaaattcgtcaagcaaaagcaaggcactcctgcatctgctccgtccgccaaagaggaaaccgcgggaatggcagcgaaagaagctcaggtaatagctacggaagtgcctcaagacatgcgacctcgctttacgatcaaagggaaagtagagaccgaaaagccggctgaaccggttccttcgcccaaggacaaggagcctgacaccgtgcgtgaggacaaacccgcaagagaaactgcacctgtaaaagaggaaacaaaggtcgtccccgtcaaggaagataagcccaaggaagaaaaaccaaagcaagaagagcctaaacgggaggaacccaaaccggaggagcctgtacaggcggctcccgttgccaagccggtcgaaaaacctgtggataaaccacagcaaccggtcatgacacagaaacctcaagaagctgaaacacctcctccggctcaagagatggagaaaaaagaagacaccgaagaagttttccgtctgaagaccaacacgcaggagccacaagtgaaggtggtcggaaagatagacctctcctcgatcaattcatccacgcgtcccaaaaaaaagacgaaggaagaccgccagcgcgagcagaacgatgccgatggcaagaagaaacgcaagcgcatcaacaaagctgccgtagatgtcaagaaagaggcggcaaaggtgagcggagagcagggcaaacgtaatgccggaggaggaaaccattcgtccggcaataagaacaacaaccgtccggctcagcagcagtccaacgcttccggaggccgcaagaacaacaagcgtcagtctctcccacccaaggtggagatctcggacgaagatgtacagagacaagtaaaagagacgctggcacgcctcacgacgaaaaaaacaagtaccacgctcgggcgtggagccaaatacaggaaggacaagcgtgatgcggcttcccgtgcagctcaggatgccatggagctgaacagcgaagagcagcacacactgaagctgaccgaattcgttaccgtaagtgacctgtccaatatgatggacgtccccgtgaacgaagtcatcgccacttgcatgagtatcggtatgatggtcggtatcaatcagcgtctcgatgccgaaacgatcaatatcgtagctgaagaatttggcttcaagacggagtttgtcagcgcggatttggtagaagccattgcccccgaagaggataatgaggaagacctcgttgcgcgtcctccgatcgttacggtcatgggacacgtagaccacggtaagacttcgctactggaccgcattaggaatacgaatgtgatcgaaggggaagcagggggtatcacccagcacatcggagcctatggtctgaaacttcccagtggccgccgtattacatttttggatacgccgggacacgaagcctttacggctatgcgtgcccgtggtgcgaagattacggatattgccatcattatcgttgctgctgacgacgatgtgatgccacagacagtcgaagccatcaatcatgcttcagcggcaggtgtgccgatggtattcgccatcaataagatagacaaaccggctgccaatcccgaaaggatcaaagagcagcttgcaaacatgaactacctcgttgaggactggggtggcaaatatcaaagtcaggagatctcggccaagaaaggcatcaacatcaccgaattgctggagaaggttctgctcgaagcggatatcttagagctgaaagccaatcctaaccgccgtgccatcggttcgatcatcgagtcttctctggacaagggaagaggttatgtctccactgtcatggtacagaacggtacgctcaatatgggcgatgtggttctggccggtacctgtcacggacgcatcaaagccatgttcaacgaacggaatcagcgcgtgaagcaggcaggaccgtccgaaccggtactaatcctcggtctgaacggcgcgccggctgccggtgatactttcaatgtattggagacggagcaggaggctcgcgaaatagctaaccgccgagagcaactccagcgtgagcagggattgcgtacacacaagatactcacgctcgaagacatcagccgtcgccgtgcaatcggcaacttccaagagctgaacctcattgtcaagggggacgtggacggctcggtagaagctttgtccgattcgctcatccgtctgtctacagaagaaatccaagtcaatgtcatccacaaagctgtggggcagatttccgaatcggatgtggtgctcgcagcagcttcatctgctattatcatcggattccaggttcgtcccagcgtggctgcccgcaagcaagcggaaaccgatggcgtagagatccgtacctattctattatctacgacacgatcgaagacatcaagtctgccatggagggcatgctttcgcctgagattcgcgaagaggttaccggctctctggaagtattgcagacctttaagatcagtaaggtcggtacgatcgccggttgtatggtcaaggaaggtaaggtcaagcgaacaagcaaggttcgtctcatacgcgacggtatagtgatccacaccggagagcttggctctctgaaacgattcaaggacgatgccaaggaagtggtggccggactcgaatgcggtcttaatctggctcactcgaacgacatccaagatggtgatataatcgaagctttcgacgagatcgaaatcaaaaagactctctaaagatcgaaccgagacgggttaccacccatgaacgcgatcgatttagccatactgataattttggcgataggattactgaaaggcctgtttgatggtatcatcaaacaggcagtttcacttatagccatagtcgttgccacgtatggttgtgccttacttgccgttcccatagagacgtggatcggaccttttttcggcctttcacgaggcgtggctcatacttttgctttgatcgttgggttcttggctattttgattatcatcccgatggtcggcaataaggtctcgaaaatcgttggcaagactcctatcggcattctcaatcacttggccggcggaatagtcgggataggtatagcagctattctgatgagctatcttttcctgattgccgacaatgttttttcaagagacgaagcggacagtgacaatccgtcccttcgcaatacttcgatgctgtatgaccatgtaaaaaacatagtcccaacttttagcccccatcggctgtttatgaattgaaattcgtaaagagcttactcagagacttcaaatatgcaagagaacaataatatattggatgaggttacaggcagtgaatataaatacggcttcgtaaccgacatcgaaacagaaactataggacgcggactttccgaagatacagttcgtctcatatctgcgaagaaggaagagccggaatggcttctcgaattccgcctgaatgcctataggcactggctctctatgaaagagcccgactgggcacacctcaatattccaccgatagactaccaagatattatctattatgcagctccgaaaaagaaaaaggggcccaagagtttggacgaagtggatcccgaactactgaagacattcgacaagctcggcattccactcgaagagcagaagattttgagtggaatggctgtggatgcagtgatggacagtgtatcagtgaaaacaactttcaaagaaaaactggcagagaaaggaatcatcttctgttctttcagcgaggctgtgaaggatttccccgatttggtcaagaaatatctgggtacagtcgttagcagtaaggacaacttctttgcagctctcaactctgccgtatttagcgacggctcctttgtgtatatccccaaaggcgtcagatgtccgatggagctttctacttatttccgaatcaatgcagccaatacaggacagttcgaacgaacgctgatcgttgccgatgaggattcttatgtgagctatcttgaaggctgtacggctccccagcgggatgaaaatcaacttcatgctgcaatcgtggagatcattgccgagaccaatgcggaagtcaagtattctacggtacagaattggtatcccggagacaaagagggtaaaggcggtatctacaacttcgtgaccaagcgaggtgtctgcaaaggcgacaattcaaaaatatcttggacgcaggtcgagacaggttctgccatcacatggaaatatcccagctgtgtcctgcgtggcgacaattcgatagcggagttttactccgttgctgttaccaataatttccagcaggcagatacgggtacgaagatgatccatctcggcaaaaatacccgtagccgtatcgtatcgaaaggtatatcggccggttcaagtcagaacagctaccgaggattggtcaagatctccaagaatgcggtcaatgctcgtaaccattcgcaatgcgacagtctactgcttagcgatcactgcggtgctcatacatacccttatgcggatgtccaaaacgatacggctatcatcgagcatgaagctacgacatccaagatcagtgaagagcagatattctactgcaaccaaagaggaatcggtacggaagaggccgtagggctgatcgtcaacggttatgccaaagaagtgatgaataaactgcttatggaatttgccgtagaggcacagaaactacttagtatctctctcgaaggatcggtgggataaagatctctgcaatcatttcaaaataaaaaacactcaagtatgcttaagataaagaacctccacgccacagtacagggcaaagagatattgaaaggaatcaatctggagatcaatgccggagagattcatgctatcatggggccgaacggatcggggaaaagtacgctctcttccgttttggtgggacatccctcctttgaagtcacggaaggagaggtgacattcaatggaatcgacctgctcgaactcgaaccggaagaacgtgcacacctcggactctttctcagtttccaatatccggtcgagatcccgggcgtcagcatggtgaatttcatgagggcagctgtcaatgaacataggaaagcgatcggagcagaacccgtatcggcaagcgacttcctcaagatgatgcgagagaagcgtgccattgtggagctggacaacaaattggcccagccgttcttgtgaacgaaggcttctccggtggagaaaa

SEQ ID NO: 28 - DNA (genomic), 767 bp, PORYPHYROMONAS GINGIVALIS; double-stranded, circular
  misc_feature 1...767
  hypothetical: NO
  anti-sense: UNKNOWN
gtgtttttggcgataaggtctgaccttgaaaaaaaggattctcaaattgatcaatatattttcctctatgtcttatcgattctgatatataacacaactatttcttttgaagtgggtatcaggcttatgttctatccttttatgttcatattcatattgatccctaatgcttatgtattgtcagataaaatatggcaaaaaggtgtgattttggctattttggttgtgttctcattctttatgcttaaggatctcagcagtccagctgaaccatacgctaactataagtctatactcttctgaaaaatactgtttagagaattatgatcgtgcattctcccttggtcagcgtgcttattcctccatacaacgtggagaaatcagaaatcgagtctgattttgaaatagcctacttgaatgtagctaaaatgttttatgacaaagctccctgcaatcaatataagacgataagggaatacaggccactgaatccgaagagaatcgcctccatgcaataccattcgttaatccgatttaggtttgcttgtcaattgtcagactcttctgttctgagatatttaggatattttctgtgtaaaacagaacagaagataaaaagaatgatgagagcctgactttgtgttgccacagtctttttcctacaaagtaattcgacataatatgataaccgttgcccatctgatcaataacattggccaatcaggaccggggatagtcatgcgcgacatcattcgacacatggatcg

SEQ ID NO: 29 - DNA (genomic), 930 bp, PORYPHYROMONAS GINGIVALIS; double-stranded, circular
  misc_feature 1...930
  hypothetical: NO
  anti-sense: UNKNOWN
aggttctccgtctcacacagatcgatgtgcacagtttgggtgagctgcgcgtcaatcaagcactgcgcaatatcgaagctttctacgaagctttcaatatacagcctactgataagatgtatttggaacccgaaaagcgtgtagtcgtttggtaagctgaccgacactcctatacgggaaaagaggctacgttccgaggattattccttggaacgcagcctctttcgttagaaaaggaacctaatcggagaggaaagagcataaggaggggttataaactcggcctatcgctcatcagaataatgagaccaattcgagggacgcttggtaacggctgccaccaatacaccgatcttggccgcaaaggcttctgccaatggctcggccgcagcttgtaccgtagccccggtagtcagcacatcgtccaccaaaagaacacggataccggccacgcgcgtattcggggagagggcaaacttccctttcatggctgactttcgttccgaataggactgtccggtctgactgtccgtatatacctttctgcgcaaaccttcttgaacaggtattcccgttacgcgacttaatccttgtgcgatgaggagtgcctgattgtagccacgcttacgttgtttgcgtgggtgtaaaggaaccggcactatcagatcgtaatccttggacaggaaaggataggatcggccggccattcgtccgagcatttcgccgatctcactgtatcctccatattttagtgcgtgtatcataggccttacacccccgtcctctttgaaaataaaaaggctgtacagcgcgtcgatataaacatccccattcagacgatctaatccatattgcatcccttcgatataccgnggcattctcaccatgcaacgaggacagaccccgatctccgtctcggcgagcaagctg

SEQ ID NO: 30 - DNA (genomic), 524 bp, PORYPHYROMONAS GINGIVALIS; double-stranded, circular
  misc_feature 1...524
  hypothetical: NO
  anti-sense: UNKNOWN
tgggctgtcgtattccaacgtgccgaaggcgaagtctgggctgccaccgaccatcgctcttctcagagactctatttccgtcttgcggcggacggactccgtatggcagaaaacggttactcactgttcaccgagcgagatagctgggatggtgacgctgttctctttttcttgcgttggggttatacacctgctgatagcacattgatccgcgaaatacggaaacttccccccggccatgccctacgctatagagtcggagagggtattacgaccactgcctatgacacagtagaccgatatgccccgttngacagccatttttttatcttatgaaggaggnttaaaggagtnnctgaacccccgccttattcttgccggcaagagactcgttcgctacctgaatggcagatcggccatacttcccctttccggaggatttcgactcgcggatgatagcctacatgctgcatcgtctgaagtacccacatgtctatttgtatctcctatggcaaagaggaaaa

SEQ ID NO: 31 - DNA (genomic), 726 bp, PORYPHYROMONAS GINGIVALIS; double-stranded, circular
  misc_feature 1...726
  hypothetical: NO
  anti-sense: UNKNOWN
ntccccggcccacatcgtccaaacgggcagcagcccttcgttttgctcaccgaaagcgacgagactttctgccatatcggctgcacgttcgggaaaaaggatgttgtacaaggggtgggcagctcggtaggtgtcccagagcgagaaggtactgtagtgtttgcgtgccgtctttagcgtatggatctttttgtccgctcctctgtaacggccatctgcatcgctgaaaaccgtcgggcagagcagactgtgatagagcgcggtatagaaaatagtgtccactcggggcgatattcctttttccgccactatacgcgacaaggcacgttgccacagcagcgatgcttccgcacggtagcggtcgaaatcgtggtggggagcttctttcgccagattgttagccgctcccttttcgtccacgcccgatagggcggtggagatcgtcagcgtgctgtcggacttggctattaaaaacgaaaggtgggctacaaggccgtaaccaatgaattgcgtcgtatcgttattggcatattggggtacactgtctatcgtgaactgctctatcggaagagaaaatctgctgcggaagaatatgcgctgatcccgtgcccaaccgtccgagaagcgataaccgcttatcgtgtggctgtcgatcagctgcagacggcttgtctgtcgtcctgtcccaattcatcgtgctattgagatcgaggcgacttcagtacg

SEQ ID NO: 32 - DNA (genomic), 813 bp, PORYPHYROMONAS GINGIVALIS; double-stranded, circular
  misc_feature 1...813
  hypothetical: NO
  anti-sense: UNKNOWN
atgtacaagtgaacaaaaaactcgctcccgatgagtataagatatggcgcgactccgtccgccgcagtattgccgaattgggaactcctattgcatacgaccaaacgttcaatgtgtcgtatacgttgccgactgcccaaatatccgcactgaattgggtgaatggttcattgacttataatgccgtgtataattgggatcgtggagcgaaaacgactaccgaacaaatcattgggaacacgatccggaatcaggcaacgctggaacttcccctgcaactcaatctgacatcgctgtatcgcaaatctgctttcctcaagagaatagagcagcacatcacgaatccggagaaaaaggatcctgtaaaaaaagcagcccagccattgaccaagaaaatccggttgctccccgattccacggtaacactgacgcacacttttgcgtccaagaaagtgagagtgtccgctctcggtccggatggcaagatgtatccgctgaagacaaaaatcaaggacaagaatacaatcgtcattttaaataatgacagcatagagatcaatgtaacggtaactcccccgaggcagaacggctccactcctgcattcggtgcgataggcgaaaggatggtatacgccttgatgatgctcaagagcatcaaccttaactaccggcaatcgtccggcttgcatctgcccggattcttgcccaacatcaaagctgcaggcggacaaggctccgtggatggtgttttggcaccgggatgggactttgctttcggtcttacgggagaagatttcgtggaaaaagccgcgc

SEQ ID NO: 33 - DNA (genomic), 2260 bp, PORYPHYROMONAS GINGIVALIS; double-stranded, circular
  misc_feature 1...2260
  hypothetical: NO
  anti-sense: UNKNOWN
aacagggttcggcaatagcatgtctggaatgttgccctcctgtgcgtgctttactattcaagccattttcccctttcaagaagttttgccaccgaagatgcttcagtccaaatatcggtctgacggccgaaggagctgcccgtatcttcagtatgttccccttgggagccatggtgctgacgcctttcctcggcgcattcttggataaagtcgggaaaggagccaccatgcttattgtcggagcagtactgatgtttatctgccacctgacattcgccattttcccctttgagagcggcaccacttcttctcttgccatagccattgcagccatcgtcgtactgggtatttctttctctttggtacctgctgctctctggccgtcggtacccaagattatcgaccccaaagtacttggctcggcttattcggccattttctttattcagaatatcggcttgatggttgttcccatcgtgatcggagccatcctcgacaccacgaataagggtgttgcagccggcgaaccgaagaactatactttggcgatgctggtttttgcttcgttcggtatcctcgcctttatcctcggtattctcctgaaaggtgccgatgtgaagaaaggctacggactcgaacttcccaatatcgagaaatagctgtgtaagactatgtagtcgtcccttaagaatccttttactctctgatattgagcaaattagtttgcgaaaacctatgatgaatctgcaagttttcttatctttatggcaagaaacttgcagattttcatgattaaaaagccccatcataccccttcattattcagcagtctatcagacatgctgaaccaatcgcacccactctacaaattggccgacaaaatagattgggagaaattcgatacggctttccggcctttgtactgtcagcacaatggtcgcccgagtaagccgattcgtttgatgtgtggcttgttgattctcaagcatcttcgtaatctctcggatgaatctgttgtagagcaatggagtgaaaatgcttattaccaatacttttgtggtatgcaagagtttgcacccggtgctccctgtgcctcttccgaattggtgcattttcgccatcgcattggagaaaaggggatagaactcatttttcaggaaagcattcgtgtcaataacgaagatgatgatgagcaccatcatgacacagcctttatcgattcgaccgttcaggaaaagaatatcaccttccctaccgatgccaagttgcataaaaagatcgtgcgcaagattttggacatcgtccataagttgaatcttcctcttcgccaaagctatacctttgttttgaagcggatttatcgcgaccaacgctttcgccatcatcccaagaatcgcaagaaggcgctgaaggcagacaataaattgcgaacaatagccggacgattggttcgagagctcaagcgtaatcttggagataattctctctacgccgaattgattgagaggtttgaagccattctttcacaaagacgtaacagcccccaaaagatttattccattcatgagccggaggttcaatgcatcagcaaaggcaaagagcacaagaagtacgaattcggcaataaggtatccgtcatacgctcggctacgggtattatccttgaagcccgatcttttcgaaatgagtatgacgggcacacgatagaagcttcgccggaacaagttgaacgactcacacacagaaagatcaaaataccggccggggacagaggttatcgaggccggaaagaagttaacggaacccggattttaataccggatacacccaagcaatcagacagcagacatcagaggtgcaagaaacacaaattattctgcaagcgagcaggcatagaacccaccatcggacacttgaaatcagatcatcgtttaggctgcaacttttacaaaggattggccggggatgctataaacatactgttggctgcagctgcttataacttcaaaagagccatgaaagctctttgggactttatcaaaataataagccagatgccatttgccaatggtttctcgcttaaagaggttttttaagggacgactatgtaagatacaccgtcagaaccgagagaccggattgctctgaaagaaggcagtcgtaatctccgaaaaaaaatagagctgtgcagaagggaaatcctccctatgcacagctctattttttcagcatatccaaactactagtagtttcagaaaaa

SEQ ID NO: 34 - DNA (genomic), 782 bp, PORYPHYROMONAS GINGIVALIS; double-stranded, circular
  misc_feature 1...782
  hypothetical: NO
  anti-sense: UNKNOWN
ccgttcaacacataagtccgtttgtcggatgcgggggcttgccaagtgagggtcactgtctgcccggatacagaccattggagattctgtacgggagcgaattcattgccaccttctccggtcactacaacggacgcagcatcgccggggccttgtcgttggacagtgaaatgataagtcttaccggcctctaccacataatcgttacctttggagacaccctctcctactatatatattatgccaggattggggttaatgattacatagtcataagtgccggcaggaatatcggctgatgctgttccatcaagcacgaaattcgtgggagaaaaagatgcatcggcattgaccggaactttatactcgaaaggatcgtaaagaccggccgggatcgttccgttggcaaaccaaaaagattcttcgggaatggatgcgccgtactgattgtgatctgcatcccagagcatttgatagcctgtgccgtcttcccatacatcgtgagcctccaagataattcgtgccataccggcaggaatcggatctcggagatccttggccttggatgttcgaatacctttctgcaccgcttggtgcgtcacagaaggagcagtcttcggccctccctgtgcggcagccgtctgtccccaacacaatagggataataggacggcgagcgaaaataaagaattcaattttctcataccttttgaaagtattaaaagattaatggttttcgcaagaatagtgctctaccactattcggcccgaaaagaatatgg

SEQ ID NO: 35 - DNA (genomic), 2903 bp, PORYPHYROMONAS GINGIVALIS; double-stranded, circular
  misc_feature 1...2903
  hypothetical: NO
  anti-sense: UNKNOWN
ccctggctaatgtctatccgatcaatagcttcgacggtatggctaccgacagtctcggacgctttcgttttacgacgagcagcactttcccgatgcgtctcgtggtttcgcatatcaattatcactccgatacgcttaccattcggaagggagatccgatggagaacatccgcatccgcctgcgcgagaccgatgactacaagctctccgaagtcgtcgtcagtgtctccgctttcggggtgggaggcaagcagaacaagacggtgctcaatcctatggatgtctacacgaatccaagtggtaacggagatctctcgatggcgctgcgtcagacacccggcctgcaggatgtgggagatcgtgagggctttttcgttcgcggaggagcctcttgggaaacggccgtgacgatagaaggcattagagtgaagcgttttttcggcaagaacagattcgacgctcctgctcgttcacgtttcgagacaggaatgttcagcggcctttcgctctccaccggaggctatggggccacggaaggcggtgcgctgagcggactactccggttgcgattggcgggtaagtctccctcgtccgtcgggataggaatatccccgctttttgtaaacggtgggggtgggcatctttccaggtcgaatcgtttctatatagagcaaaatgcctcagtgagcgatgccgcctatatccgtctgctgctcaagccggagtacaaactgcccggtaccaaccgctcctatgcctacaatgcacggacgatatggaacccgacttcgcaagatgaagtgaaggggctttttctcttcgtacacgacctttcctcttcggctttgcgcataccctctcctgcaactgcatatatgctctatgcgggacgaaacacctatggattcgggatggctgtttggaggcatgacttcgaaggaggcaaaacgacctccaccctgtccgccggctatagcgaagaccacaaccggctgcaccgccagcttgaaatcgagccggacatagagagcactttccgcaccgtagagcgcgatgccaatatccgccttcgcttcgattctcggattaaggcttggaagctctcctacggatccgattatacatatagcgaagccaagtcttctgttcgggaggataaatcatcagccttacccacactgcgagaacaccttgtggcagcctatgccgaagccctcttccctctgtcgaatcggatctccgctacagccggattgcgcgccgaatattccggacttaccgagtcggctattatcctaccccgtttgtcagccacttacaagctctctccttcgagccggatcaccttggatgcaggaggctatgccgcccccggcgactactacctctcccatggcattgtgccgcaaaagcgcgaacactcgcagcagtacaacctgacctatgaatggcgaccctcgcgtacacaagtgctacgcctccaagcctatgacaaagaatattcccgactgaccacgttggctcccgatggcacagcctccaacctcggcaagggatatgcacgggggctggacttcttctggaaagcatccggactgatcagatctttcgagcattggttctcctattcctataccgatgctcgcaggcagtatctcttttcgcccgatcaggaacgaccggatttcgtagccaagcacactctttccaccgtgctgaagtattggtgtgctcctatcagctcactattcaacgtgtcgatgtcctggcgttccggcatgacctaccacgatcccaacatagcctccccggcttatttgaacgcatcgctaccggccaatttcagcatgagtgcctcgtacaattacccattcaagtacaagaaagccggcggtgtacttgtcttcagcgtgcacaatctgttcaattcggatcccacctacggctatcgcttcggggacaaacccatcggaggcgtatatccatcggtcagaatctctaccccttaccgacagttttatatggtaggtctgttcatcaacttcggaatagaccgccgacaagaaatcatgaacaccgatataaaaatcaaatcaagatgaaaactttcaaaagaatcgccctgctcctcgtcgcaggctttgcagggctgtgtgcaacatccgcacaagggacggcttatgccgaagtgatgaatcgaaaagtagctgctctggacagtgtgccaccgacggaatatgccacactggctgcggacttttcccggatagcagccgtggaaggatccgactggatggctgcttattataccgcctactgccggataatcccggccttcggcaacccctctgaggccgatcggctatgcgaagaagccgaatccatgctgagcaaagcggaatccctcggcggagatctgtccgaaatagcctgtttgcgtagcatggccgcctcggcacgccttttggtcaatccgcaagaacgctggcagacatatggagcagagagcagccgacagttggctgtcgcccttgaagccaaccctgctaatccgcgagcctacttcctgcaggcccaaagcctgctgtacacccctgcgcagttcggagggggcaaggacaaggccctcccttttgccgagaagagcgtgtcctgctatgctgcggccacagtgtcgcctgcctatgctccgcactggggagagcagcaagcacgccaactcctaatgctttgcaaggcagaaacccaagagtgactttgcggccatcggtctcctgatcgagaacctctataacctgcaatcttcgaaaacacgaaccgaaatcgttccgattgtggcacgtgttttctgagaaaatggcgcgagattttttcgttgtggcgcgtaaaatttttgcttccga

SEQ ID NO: 36 - DNA (genomic), 2976 bp, PORYPHYROMONAS GINGIVALIS; double-stranded, circular
  misc_feature 1...2976
  hypothetical: NO
  anti-sense: UNKNOWN
cggaacgatccgatcgaaaccccttttttgcgatagagacaaataagactcaggtatgaaacgattgattatcgcaggcgttttggcatgcgccttgtggccggtatatggacagagagtactgagcgtgaacgaatgccggcgccttgccctcgaacacaacagagacttggccataagccgcgaaaagataaatgcggccaccagtactcgcaaagccgctttcaccagctacctgcccgagctctcggccaccggtacttacctgcacaaccagaaggaagtatcgctattgagcgacgagcagaagcacaagctccagaatctcggcaccgaccttgtcacagccatagggcagaatccctacatcacgacggctattcagtccatccttgcccagcatcccgatttggctccccttatcggatccatgatgccgcagatagccacccagacgagtcaggggcttaacgccttcggtacacacctcgtcgatgccgtgcgcaccgatacccgcaatgtctatgccggtgtgctgaccctgacccaaccgctgtatgtaggcggcaagatatatgcctacaaccgcatcacgcgctatgccgaagagatagcacactggcagcacaagaccggacagcaggatgtgatcctcgctaccgaccaggcctattggcaagtggtttctttggccaataagcaccgccttgccgagagctatctggagttgctgacgaagctcgacaacgatgtccagaagctcatcaaggagggattggctacccgtgccgacggtctcaacgtatcggtaaaggtgaacgaagcggagatgacgctcgctaaggtagaggatgggcttagcctctcgcgcatgcttctgtgccaaacgataggactgcccctcgacgagacgatcaccctcgcagacgaagggcaagaggagttgccgacgaccatcgttccggcagagaccgacctgcaatacaccctcgacaaccgtcccgaactcaagagtctcgccctgttagagcaaatctccaaacagaagatacggcttacacgatcggaatatctgccatcgctcgccttcgttgccaactatttagtgactaatccgtcctctttcaatggtttcgagaataaattcggaggtatgtggaatgtgggtgtgatgctcaaagttcctatctggcactgggggcagggcacgcataaggtaagagcggccaaagccgaggcacgcatcgcagcccaacaacttgccaaagcacgcgaaagcatcgagctacagctctcccaaagcgtcctgaaagtacgggaggcagacaaacgacttgtcatggccacgaagacatggaagaaagccgaagagaacctgcgctatgccaatgtaggtttccgcgaaggcgtaataacggcctccaacgtactggaagctcagacggcatggttgtcggcccggtctgcaaagatcgatgcacagatcgacgtgaaactgaccgaactgatgctgcgcaaggcttcgggacacctctccccggaagaagtcgtttcggaatgataccgtttttccttatttcgttattcatctgatcaaacatattatcattatgacggacaacaaacaacgtaatatcgtattcccggcgtttctcctcttgctgggagtcatcgcagtggtgacgatcgttggttttttcatgctcagaccggccgaggagattatccaaggacagatagaagtgaccgaataccgagtgtccagcaaagtgcccgggcgcatcaaggaacttagggtatccgagggacagcaggtgcaggccggcgataccctcgctgtcatcgaagcccccgacgtagcggctaagatggagcaggcaaaggctgccgaagcagctgcacaggctcagaacgccaaggctctcaaaggagcacgcagcgaacagatacaggcagcctatgagatgtggcagaaagctcaggccggcgtagccatagcgaccaagacacaccagcgcgtgcagaacctctatgaccagggagtggtaccggctcagaagttggacgaagccactgcccagcgcgatgcggccatcgctacgcaaaaagcggccgaagcccagtacaatatggctcgcaacggtgccgaacgcgaagacaagctggcagcttctgccctcgtcgatagagcgagaggagccgtcgccgaggtggagtcgtacatcaacgaaacctacctcatcgccccacgggcaggcgaagtgtcggagatattccccaaagccggcgaactcgtaggtaccggcgcacctatcatgaatatcgccgagatgggcgatatgtgggccagctttgccgttcgtgaggatttcctcagcagcatgaccatgggagccgttctggagactgtggtgccggctctgaatgaagaaaaagtacgcttcaagatcacattcatcaagaacatgggtacctatgctgcctggaaagcgaccaagacaacagggcagtacgacctgaagaccttcgaggtaaaggccacccttgcggataaagacaaggcacaaaagctacgcccgggtatgtccgtgatcatacgcaagtaacgatgagcagtaaggccatgcacgggacagcccttatagccaccatgcgtagagaggtgcgacaactgacgagtcgcgtcctcttcctcttctgcatggtgatagctcctgtcttttgctgtctcttcttcccctccatcatggatatggggttgccgcagaacctgcctgcgggtattgtggatctcgatcgtacacagacgtcgcgcaccatagcacgccacctcaattcgatggagcaaacccaaatcgtcaaacagttcgaaggctgcgtgaggctcgcttgcagtacagcgaggcgagatatcgtactactatatacccgaggaatgacacggatgcctacgcacagaagcagccaagctctctt

SEQ ID NO: 37 - DNA (genomic), 656 bp, PORYPHYROMONAS GINGIVALIS; double-stranded, circular
  misc_feature 1...656
  hypothetical: NO
  anti-sense: UNKNOWN
cggctcgtgcaggacaatacatgcttgtctgtacgggcgatatggaatcgcttatggaagatgcctcatggatagagttggcttccatagaagtagcagagcatacgagcacccattcatcgttactggtggcctccaacccacagatcgatcttctcacagttcatcgggccaatcccgagacattgccgactttcagcattacaaatgaaggtggtgctactttctccgggaaaatcgaaatagtggctataaaggctttctcggaaactttcttccaagcgaaagaagaacacatgagtctcgcccaaggggaaaccaaagtattgtctccggagctgactgcgaactcttctctctatacaaatgccgaactctttcccgatggcacctattacattgtcatcagagagcagggattttgggatccgatcgatttgtttggggactattactatcgtatccgtctcattacggatctatcctcttcggacatcgctggtaaggatgtttctactatagtactttatcccaatcctgctcacgactatgtccatgtagccattcctcccacatatgcgggcagcacacttcgtttgttcgatattcaagggcgaatgcagctctccacgaagatcgaatctgccgatatgcgt

SEQ ID NO: 38 - DNA (genomic), 686 bp, PORYPHYROMONAS GINGIVALIS; double-stranded, circular
  misc_feature 1...686
  hypothetical: NO
  anti-sense: UNKNOWN
cgatttctggagggctatcatccgatccagacgggatagctttacctcttcgggcacatcgtccgcgaggtggcgagcagcataagtacccggccgttcggaatacttgaacatgaaggcagagtcgtaacgcacctcttccatcaggctgagagtggcttcgaagtcttcctccgtctccgaatggaagccacagaagaggtcgctgctgatggcgcagtccggtatggcccggcggatagctgctaccctgtcgagataccaccggcgcgtatagccgcgcttcatgacgcggagcatcttgtcgcttccgctctgtgccggcaggtgtatatgattgcagatattgcggtatcgtgccatgacggcgatggcctcgtcatccatatccttggggtgaggagaggtgaagcgtatgcgcatgtcgggcacagcttcggccactgctgcgagcagatcggggaagcggatgatccgcccgttttgttcgtatcggtaggagtttacattctgccccagcagcgttacctcgcggaaattcttggctttcagatcccgcacttcgttgaggatgctttctatttcgcggcttctttctcggcctcgtgtgtagggtacgatgcagtagctgcagaagttgttgcacccacgcatgatggagacgaatccgttgatatgtacgccac

SEQ ID NO: 39 - DNA (genomic), 4212 bp, PORYPHYROMONAS GINGIVALIS; double-stranded, circular
  misc_feature 1...4212
  hypothetical: NO
  anti-sense: UNKNOWN
tttcgtagccatgcacttagtgcggacgaatgagagagagatcttcttgatccgtgtaatagatacccgttctatactgagagccgacatcgttcccctgtctattgaggattgtaggatctatggtcttgaagaaaagatcgagcagcagagagagcgatagctcactcggatcatattcgactcttaccgtctcggcaaatcctgtggtttgggaacagacctcttcatacgaaggatcctcgacattgccgttggcatacccgacttcggtagccacgacaccacgcacttgtttgaagaaatgctcggtaccccagaagcacccaccggcaaagtatattgtcttcgtctcgggaatactgtcattatgctttgccgaagaagagcaactaccggcactaagagaaaaactaaaagaagccatactgataagaataagagaaagatacttcataacaaatcggattctcttttcatgagaatggggaagagacagactcgaagtagtggcaggtcctattcatgatgatagggctcatggttgagaatagtcatggcacgatacacctgttcggtgaagaagaggcggatcatctgatgagagaaagtcattcggctgagcgatattctatcggttacagcctcctgcactgcagggctaaatccatatgggcctcctatgacaaagaccattcgacgggtgccgatcagcattttcttctgcaaaaaggctgaaaactccatgctggaatactctctgcctcgctcatcgagcaatacggtgctgtccgacggccgaagacgagcgagtatctcccgaccttcggcatccttttgctgttcggaagaaagcttgctacccagacggacatcgggtattacctccacttcgaaagaaacataatggctcaaccgacgaatgtattcctccgttgcctgaaccattagtttgctgtcggtcttgcctacaacgagcagtacgatcttcatcagaaaggcagatcatcccccgcatcggcgttggaagcccaacccgttgccggctgagacggcatgctcggttgttgcgttggaaaagtcggagcaccggcggcaggcatttcctgtggcaactgctgctgaccttgctgcccgatatatccgcgctccatgcgccaagccttcacatcggtgtaccaacggccgttgaactcacggctttcaatatcgacccagaccgtaacctgatcgcctacttgataggaaggatcaatacgatctccccacacgctgaagtgtattttgcgagggtattgatcgagcgtttccagtatgtactcttgttttttccattcctttccggaagccttgccgactcccgaattgagtggcagtatctgaataagctgcccttgaatctgaatatccatatttgttttgttctaacatagttatcgttggttttccaacgcctccgccatggtcttatcgaaaaccgatgatgtggcgtacttcggcaagggttcgtgcagcactttcacgagcgcgttcggctccttctcgaaccactctgtccaaaaatgcttcatccgcctgaatctctaatattcgttcccttataggagtggtaaaggcgacaatgtctgccgccaactgcttcttgaggtcgccatagcgaatagaacagttattatagaggtcatcgaaatggcgatagacctcatccgaggatacgatacggagcatggagaaaagattttccaccggctccggcttcacgctgttaggcacttcgggaccggcatcggtcacggctttcattaccttcttgctaatcgttttggcatcatcggccaaatagatggcattgccttcgctcttgcccatcttgccggatccatccaagcccggcaccttcaaagctgttgcacccggagagaacgattcgggttcggggaagaagtccacctcatagatcgtattgaaacggcgggcaaacttgcgtgccatctccatgttttgctcctgatcttttccgacaggaactttcacggcacgatggatcagaatgtctgctgccatcaatgtcggatatgtgagcaggccggcattgacattgttcggctgcttacgggctttttccttgaaagatgtcgttcgctccagctcgcccaaatacgcattcatattcagatagagataaagctcgagcacctctcttacatcactctgtacatagattgtagccttctccggatcgatcccgcaagccaaatattcagccagtatcgtacgcacattgcggactatattatccggatgcggatgtgtggtcagcgaatgccaatcagcaataaagaaaaagcaattatatcgatgctgcatatccagaaaactccgaatagcaccaaaataattgcccaaatgcagattgccggtcggcctgataccactgactacagtttccatacacaaatcctgttttatttgttttccgatggtcgcaaagatagggaaaaagaaactttttgtccgtaattaaagcattttgcagattctgcggattccggctatcagtgcaatactaaggtaaattttgcaagaagcattcgagcggagttctgaattcgaattcctttcttggtctacacattcgggacattccgccaacacaccttcaagtctggcaagacttgctcggccgacagagaaccatcagtctctcggaaatttccataaaggtatcagaagtccattctttcggatgtctgaaagtcttcgttgctctatgaaatatacgtgccaaaaaagttttcaacaacgaagctgagtttagaatcattccaaataagtatccgaaaggaagcggattttgaggtgaaagagacaagaaagcgaccttttggggcttgcaattcgctttgtaggaggttgatttgcgatttatatataaaccgttttcgatttgtatatagatcgtttctaatttatatataaatcgcttttgattaatatatagattgattgccatttgtatataaatcggatagcccaaaaggcccttatcgagggccataaataaagagacacgcgccaggttcactatagaactcggcgcgtgtctctttattttgagtgctttatggagaggatctgttcctttttatttgtctgatacagcctcccctttattcaaatactgcgatgtcgaatgtatctgtcggggcgacaatgccgaccgcaaagctcgcgtgtgggaggtaatttcagtactcataatttattatcgtttagtcgtttattaaagtaattctattcgttcgaaagactgttcggtcgcaacattaagctttctgtagaaacctctatcggccggcaaatatagcgaagccgaaactacagggaatcgtaatctgcacattcaattatcaagtgcaacggtctgcccattttatccgcgggtctatctgtttaggaatatgtgaagggtgaaaaggtgtttaagattcggcaaaaatagtgtagctttgcaatctaagttttttgagaatgtccgcacagacttttttcttcaagctactgttgcctgctttgctcctttgcacaggagtcgtttcggcacaaaccaacgttgcttcctatgagcctgtccgctacaatggagaagggatcgtctatgccctcccacagacacgcatcgttgtacgggcacaattagaacgtactatccacaagcccggaccgctccatctctatgcccaaaggtacttcggacaggaggccggcggagaaccgagcatccgttaccgtttgggtagagtgatagcccaatctgtgggaatacccgatttcgatcaaaaatatatagtagagttccgtgccggtacggtggcagacttcgtaaccctcaacaaaagaggtatcatagtcggtatcaatgccgacaggcaagacctgccgtcaccatgtccggacactctcttccgtttgccgacaatacagcccggcatagaaaaacgtcctgctttgcctcaggaatataccgtggcaggcacgaaaggaaagcaagcggaaatcgccgcagcccaagtattccgcatacgtgagagcctgatggatttgctgaccggtcaggctgagaacatgcccaaggatggagcggctatgcagctgatgacacaagagctgaaagcacaggaaactgctctgctggaattattctatggaaag

SEQ ID NO: 40 - DNA (genomic), 748 bp, PORYPHYROMONAS GINGIVALIS; double-stranded, circular
  misc_feature 1...748
  hypothetical: NO
  anti-sense: UNKNOWN
cggcattattttttttctgaactatcattttcttactatgctgtatgctttatcgtatggctgcattttgctgaggccatacgctaaaaacatttcaaaggtatgtatttgtttggataagcttttccctatcatatattatcgctgctcgtctaacctctatcattgagtatcgtatcatccgccagcaattcggttagaagttcccgacggtattctggtggtagaaacttcttgtcaggcggatagttggggtaagcctgaacgtacaagaaaattatcatttgtgggaccaaaaaacgtggcgcggcaattttttgcttttggttcgggaaaaaataatttctcgaaccaaaacgaaaaaaaactcgcgcgtaaattttcaaaaatacgaaccataatctcgacactttgggttcgtaaaatctttttggccaaaatctttcggaaaaaacaaggtaagcctcatcatctttcttgttgtggaaatccgtgtcggcatggagttttacaccggttttcctgtcggcctcttccatcaataccgatggaagcaattcgcagggtctgcaagtttgaaccggatactttatttttgttctcattacgaaactattttcggacagcgatatgagccaaaagcctacaaacgatcggaaaatcatcctcattaccggcgggcacgttcgggcaaaagtctctatgctgagcagatggcactagcgcttgccgtcatcctatctacctg

SEQ ID NO: 41 - DNA (genomic), 3471 bp, PORYPHYROMONAS GINGIVALIS; double-stranded, circular
  misc_feature 1...3471
  hypothetical: NO
  anti-sense: UNKNOWN
ttcataggtataaacgaagacagcacgacctcctttcgtgcccatcgtagggtacacgatatgttgcgctccatgcttccgcctcataagtcctttatggtacaatactccaaggattttaccgattggctcccttattactggcaaggttactctcagactacgcgatatacgtacaggatagatctaagccctggaatcgatgtcgtacggatggctnattcgncccgacgccatgaagaagatacgtaaggctgaaagagacggactccgctgtacgtcggccacggtggacgacctgctgcgcctctgccgtatatccatgttccgacaggaagcatanggattttgcagcggagacattgcagcggctggcggaagtcgccatcgaaaggcatgcaggtgaaatagtcggttgcgaagatagcgaagggcgtctactggctgccgtcttcctcgcccacgatcataacacggcctacacgattgcttccggccaaattcgtgaaggacaggggcgcaatgccggagcttttgtcctgtatgaggccatttggagggcttgtgagatggaaggcattcatacatttgacttcgaaggttccatgttggaggggatagagggattcttccgctcgttcggaggtatccaaacaccttatttccgactgtccaaaggtcggattggcttatatggccgactaagacgtaaatggcgagcctttcatgataccggtcagcaaaaacaggtatgaatactgaagtaatccactacatcattcgctttctgatcggagatgaaagcggaaacgatcagctcctcagtcgcatcggttatacctcgaagcagagcgagatgtcccgatacagcattgtcatccgtgcttcaaacttcttcgattcggatatttacgtaccgataaggcttttcccttgttaccgctgaaagaatgggagggcgtacctctcctttttggagagccgaccgaagagctgttggaagagagcgacacactggtgctgaatgccgacattgtcgcctctacatatttctgatctcccgctacgaagaggatgtaccggcgtaaacttcgagatatacacggacgatttccgggaagagagtccttgcctttcaaagcaggatttctacagcgtcctgtagtagatgaatacggggccattctgcgcaccaaaattcgtcagatgggctggccggtaaaagacccagtcccccatttctccatggtgaatctgacgcatgacgtagacgaaccgttcgagtacagaggatggagaagttttgcccgagcattgatcaaaggaacgcaaatctcccttcaaggctttccgtctggcttatgccaatccggcaagtgatcgtttcttcacttttccccgttttgtggattgggataaaatattgcgcagcaaaatgccggattgctgtcggattatcttcttcttcaaagcacccggaaaggccccacaggatgcaccgaactattcgctgagaaaaccgctctatcaatcgctccgatctttggttaaaaacaatggaatagtgatagggcttcacagcaactactctgccggtctgaacccagaactgatcggaaagcagcgcaagcgacttatgagcgataccgatatggcagtcgactgcaacaggcatcactaccttgcagctcgtgagccggaggacatgcaagccctgatctcggcaggtatcagacacgattataccatggggtatgccgatgttgcaggtttccgccttggtacatcccgtcccgttcgcttcattatgccttccacaagacggctgaccgagctgatcctgcacccacttacactgatggattgtacgctgcacaggcaagagtatatgggcctggaacgaagctacggccatagaagttggtgcaaggaaactgctgatgcatactttcatccacggaggagaagccacactcctttggcacaacgaatatctctctcgcnacattcatccctggcatgcccgtttgtatcgagaagtactgaggctgatagaaaccatggaggaaaaacaagaggaggaatctttcgactacgaaacggccatcgaccaatgaaacgggtactcatcttcgccgatatcttccctccggcttttgctccgagagctgcctatctgaccaaatatctgcctcgatttggttgggaaccttttgtaataacggaaaaaatgccgactccggcatcccagtcgcacggcgatgtgtttggtggattttgcagtgatattccggtaacggctatcgatctctcttcggcttcgtttctgtctcaagcgattcgttcagctcgtctgttcggcgaattgttttgggagcagaaagaagagcgattctacaaagaagcggcgaaagcttttcccagtgtcaaattcgatgctgtactttgtcttacctatcgcaagtttccccttgctacggcttgccgctatgcacaggcacatcgattgccctgggtggcggattgccgcgatgtgatcgaacagtacagcaactacgattttcttcctcgtggcaagcgactgccaagtctgctgatgaagtggcttcgacaccgctatatttctctccgaaaccattatctccacaaagctgatcgtgtagtttcggtatcaccctggcactgcaatctgctcgcagaagttaatcctcgtacagaattgatctacaatggatatgatcccgagcttttttctcgaggatcgcttccttgtggcaaattcatcctctcctatacaggacgattgctgactccggaaatgcacgatcctacccttttgttcgaagctttggcttctgaagctcttcaggaggtgcgcaaagagagacgaatagagctgcactggtatgtggacgaatactcccgctccatcctgcaaccattcattcggcagtatgctctgaaggatatgtgccgctttttcccgatggttccggctgttcaggtacccgaaattctccgccatagcagtgtcctgctccaactgggcaacacagagaagcccggaggcccccatggtatagtatcgaccaagctattcgagtcactggccatggaaaaacccatcctgatggtaaggagcgatgaagctatcgtggcagatattatatcggaggccgaggcaggattggctgcacagacgacagaagaggtagccacattcctgagtgatcaatacactcgctggaaggcagaaggggatacttctcttcggaacccgaacaggaattttatctccactttttcgcgtgaagaggaagccaaacaatatgctcgtctactggaatcgatcgtcgctaactaaattcagcatcgtatcatgaagtactgtgattttacgccgttgcctctcccttcggagcctaatacgacagtcattgccggtccttgcagtgcagaaagtgaggagca

SEQ ID NO: 42 - DNA (genomic), 640 bp, PORYPHYROMONAS GINGIVALIS; double-stranded, circular
  misc_feature 1...640
  hypothetical: NO
  anti-sense: UNKNOWN
tggattccggcagatttctccgtccaactttagaagaatgagttggataatttggggtaagaggtgtagatggattgttggaaacataatttgtagggaaattaattgctccttgtataaccaaatcaatgggatcattcgcatttccagttttgccaatgaagtctgcagtagttacatttttaacaggatactgcttccgtcgcttaacccgtcagacatcaatatgatatgcttatccacagcagtagaagtggccataatgtttctcgccattttaagccccccctgggtatgtgttccccaaataggagtcaaagcccggattttttgacagagaaaagcagtgtctttggtaaaatcagataagcgatgaggctcatggtcataactcacaagagcgatncgcaccccttctgtagccgtccccttaggcaacatttttttcacaaaacgctgtcccgatgcaatggcagactttaatctggcaatgttttgccctcccattgacgaagactggtcgataaccatcaccacatcgacaggtactgttaccgctttagtagtgatttttagcgtcacatcccaagcattgggattttcaggatccattggattggcaaccggtaccgcatacttg

SEQ ID NO: 43 - DNA (genomic), 624 bp, PORYPHYROMONAS GINGIVALIS; double-stranded, circular
  misc_feature 1...624
  hypothetical: NO
  anti-sense: UNKNOWN
ctgctctaataaagaaggtgatataatagctcttgttacttcatatacaggatttatgagtggaacccttgcgatcagaaaagcagatgaaggcaaatggcaacttgttggcggagatatacagaatgcgatcgttcaaaatatatgcatgatggacgacaacaagattgcttgtgaagtcttcgggactcctaacggagtagatggtcggacaagggtttgtgtttctgacgcatctgtctttgattttgagtggtatgaagatgaaatatacggaggcctgatatttgacactttcttctatagcccttgggacaaacttctttatgcgaaatttggtgggattatgctcaggagtaaagagtcttttataacctctttcatttctccgacagttgtacaaggagtggatgtctatactttggcccgggaagataaggatcgaaagtgaaactccggtgtctgaggtgttgcttttcgacctggctggcaggatggtacttcggcaaaccattgataataaaatctattcggacatagatactaacggactaaagcgaaagcggtatttacgtagtctcggtgcggtctcttccggacaggtatcagtcctaaggtgcaggt

SEQ ID NO: 44 - DNA (genomic), 662 bp, PORYPHYROMONAS GINGIVALIS; double-stranded, circular
  misc_feature 1...662
  hypothetical: NO
  anti-sense: UNKNOWN
cgatggtttgttattcatagaagagttgcctaagatcttacaatatccgatagtggtgttctttttcctcatggtaatcaatagtataaatctaattgatggaatcgatggattggctacaagtctggtgcttctggggatgttattttatataccattctttatctatgtcaatatgtatttatatgtaataatctgtgtgtctgttattggttgcttgggagcttttcttcggatgaatctttatggtacaactgagaagcgaacaaagattttcatgggagatacgggatctttaactttaggccttcttttgagctttatggccttacgcttgcttacccccattgcaaatactgctttacctcttccatatgtagtagctccgctacttattccttggttcgatttattccatgtttttgtattgagaattttatcaaagaaaaatccttttaaacctgataagagtcatattcatcatagacttatggctttggggttgacgcagagacaaacactgttgtcatattactatactctatcgcgttctctttgttaatatctttgggtacccattttttaatatcaatgtgctgctctgctggatatcgtcatatggatcacatccaatatgcttatagccaatctttcgcgcaaaa

SEQ ID NO: 45 - DNA (genomic), 351 bp, PORYPHYROMONAS GINGIVALIS; double-stranded, circular
  misc_feature 1...351
  hypothetical: NO
  anti-sense: UNKNOWN
tgatcgccatattgtcccaagagcataaggatatggaggagaaagtccgcaagaaacttcaggaaatgatagcggatacggatcatcgtctggatatgctggatcggcagaccgaccgaaagatcaggatcggcagaaagaatgccggcctgccgaagtcgggtgtcatagccgactggctggtacgggatatgatgcgctttcagcccgtggcgaaagacacgagtggcaagcctctgaacaatagcaaggccaacagcaccgaataccggatgctacagcgcgccctcgcccttttcggcggagagaaagagcgtctgacaccgtatttccgccagatgaatctgacgg

SEQ ID NO: 46 - DNA (genomic), 670 bp, PORYPHYROMONAS GINGIVALIS; double-stranded, circular
  misc_feature 1...670
  hypothetical: NO
  anti-sense: UNKNOWN
ccgaaccaatggcttggctatatgccggaggcgatcgtagaatcaacaaagtggtgggggaataccggcaatgctgagaataagccgatcaacttcttccgcctgacaactcgcggtggacttgtatatgacgtgccgattattacgcacgaaggtgctattccgggagggcagtacttaccttttgccaaaggcttattggcggataagccgagttatacggtttataggaatcgtcattacatatatcgtatcaagacgctgccggataagatagaagtgaagtattctatttgcgaatggaattttagtacccaacgatacttatatgggctatggctacaacgtgggagtcgatgagcaaggcaatgtcaccattactaatacgatgcagaattgtgatccccatgttgtgagactcgttgctaaaaatggtgcttactttggctcccagcctaccgatacttcggttgagtttgctgagttagccaacggtgcttcgcaaacattcaaagtaaataaagatgctgtggcggtcggttctgcttatctggaggtttattacaacccggatccgaatgcaacagggtcgttccggataaagttttatcaagaaatagacagacttatgaaaaagtattggtatatgcctcgttgctaacgagtgttt

SEQ ID NO: 47 - DNA (genomic), 666 bp, PORYPHYROMONAS GINGIVALIS; double-stranded, circular
  misc_feature 1...666
  hypothetical: NO
  anti-sense: UNKNOWN
gctcaacaagagaagcaggtgtttcattttctgaaccttccggctactgcacaggctttggctgccggaggcaaagctatcaccatcgtagacgacaatcccggactggcttttgagaatccggctctgctcggatatgaatccggtggccgcgcctttctttcctatttatattatatgagtggttcgcatatgggcaatgcctgttatgcctcgtccgtcggagagcgtggcatgtggggtgttggcatgcgtttcctgaactacgggtctatgcaaggatacgatcagaatgcgattgccaccggctcttttagtgcttcggatatagctgtacaaggattttacagccatgaactgagcaaccacttccgcggtggagtcagcctaaaagcattgaattcttctatcgagacgtatagttcctttggccttggtgtggatgtcggtatcagttattacgacgatgacaaaggatattccgtttccgctctgttcaagaacgtaggggcgcaactgaaaggctataatgaagaacgggaaccgctcgattgggatttccagctcggcttttcccgcagttttatcaatgctccgtttcgcttgcacatcacgttgttcaatctgaatccgcactatttcaagcgtcttgtaccacgcgatctg

SEQ ID NO: 48 - DNA (genomic), 512 bp, PORYPHYROMONAS GINGIVALIS; double-stranded, circular
  misc_feature 1...512
  hypothetical: NO
  anti-sense: UNKNOWN
ttatgcctcaaaaattttatattcaaaagtttttctcccatttcaataatgcttttgacattttcttctgttgcaggctgtattttatgcactccaaatcttttagcgatatcaggagatagttttagcaattctcttcctgtctgattaattccaatgattacaagcttgggatatttgggattggcaacattgtctgctgcaagctttgcaatattagacaaacgcaaacttcaaatgggtcaacaagtctatggaaatcatctataacaaaatttcctccctcttcaaaattactattaatgagttgatttattntcgtcgtttcatctatatttcttgctgacaagtattcaaaatgtatttcttcttttatgtcagataatatcttcaaaatagtagaagtcttccctgttccagtttgtccctctatgataactggcttctttatacttgttacatcaattagaattttcgtagtagtttagnggttcgacatatgttaagtgcgg

SEQ ID NO: 49 - DNA (genomic), 394 bp, PORYPHYROMONAS GINGIVALIS; double-stranded, circular
  misc_feature 1...394
  hypothetical: NO
  anti-sense: UNKNOWN
aaaagagatcggaagacagcgaaaagagattgggaaacgatttatatacagaacgaattcgatttatatatttatcattttcgatttatatataaatcgttttcatttaatatatagattgtaaagtgttttatatataaaacgagaggcagaaaaggcctcttcgaccgatgaaataaaaagaggcacccacccaagttcgcgaccgaactcgggcgagtgccttagtatctgacagaaatgtcgggatcttattcgcgcttgtacatcacaaattcggcacaagcgtcctcgctcgaccgattacttcatgttagtcttcccagcgtacattgcgcatgtcgccgctcttggccaattcctgatggaaagcaaagcagcagtccagatcctg

SEQ ID NO: 50 - DNA (genomic), 601 bp, PORYPHYROMONAS GINGIVALIS; double-stranded, circular
  misc_feature 1...601
  hypothetical: NO
  anti-sense: UNKNOWN
gctgtcgatgagtttcttgagtttgagctcgatttgatcgcagagggcaagcaattcggtacgatcggcgaactccacatcttcttcggggaagtccaattccaactccatcagccccgtaaggcgaagcaattcctcacgcagagcattcagttcctcgctatatccaccacgcagttgcttcatcgccatctgatgctgtgccttgctctcgctggcgatgatatccgccaccggctcggcactactcaggtccatacgcccattgaggtaggcacggcgagtaaattcgccccgntgtgccagaccgaacaggcctgatttgatcaatgccttcgagaataccgtctaccgtatattatatggagccatggcaggcaatctcgactggatgctcggcagtgaaggagtgcnggccatggaaacacgttaggataacttcgtcaatgagttcgtccggctccatgaatttcgccatagaaggcggtgcgaggcttggcttccgctgaagtcaatcggcttggccacgatatagaaaaagtgggctaacgagcggaaagcattccggaccggacacacgaattcaccggaataccggcca

SEQ ID NO: 51 - DNA (genomic), 483 bp, PORYPHYROMONAS GINGIVALIS; double-stranded, circular
  misc_feature 1...483
  hypothetical: NO
  anti-sense: UNKNOWN
gtacaacggctcgttcgaagccaattatctggtatcgaagtccggcgacaaatacgtgcccggagactacagcaagaccaccagtctgaatatccgatggacacacagtcaggatccgaaggccaatcctttgcaaacgttgtcggccaatgtcaattttgccaccggnagctatttccagaattcgctgaataccacctatgatgtcaatgcccgtactgctacgacacgaagttcggccgtgagctattcgcgcaagtttccgggtactcctttttcgattacgggtagcatggatatcagccagaacatgcgcgatacgacggtgagccttaccttgccgaatctttcgattaatatgtccacgcgttatcctttcaagcggaagacccgtgtaggaccggagcgatggtacgagaagttgagtgtgggctattccggtcagcttcgcaatagtatcttgacaaangagaaagatttgct

SEQ ID NO: 52 - DNA (genomic), 527 bp, PORYPHYROMONAS GINGIVALIS; double-stranded, circular
  misc_feature 1...527
  hypothetical: NO
  anti-sense: UNKNOWN
cgggctgtaactacaatctttctcattgttctttacttattgtttttaatgttttgagtcacggtatcaccataatagcaatcagtgctgagtttggcaaccgtccttataacaatcggattcacttttttgttgtgagtttaatcacagatctgtcgagaagtttatcggcatgcttcgagtatgcggcgagccataggcccgtcgacatccaatgcttcgccatagctgacccctcgttcgatgaatcgacgctctatttcctttatcacatccgatcctatgtgcatttcttccagacgggtcttcagtccgagttcgcggaagaattcctccgtccgagcaatagctgcatctatacgctcctcctctgttccctcttttatatcccagattcgttcggcatattggagcatcttctcccgcttgtgatcgtgtcccaaggtgcgaagagtacccggtagcactatggccagcgtgtgtccgtgtgtgagtccggtcagtgccgtatctcatgaccgatcatg

SEQ ID NO: 53 - DNA (genomic), 908 bp, PORYPHYROMONAS GINGIVALIS; double-stranded, circular
  misc_feature 1...908
  hypothetical: NO
  anti-sense: UNKNOWN
cggcaactccatccttatcaaggtaaaccagattggtacgctcacagagaccctgaatgccatcgagatggcacaccgtcacggctttaccagcgttacttcgcaccgctccggagagacagaagacaccactatcgcagacattgctgtagcaaccaactcgggacagatcaagacgggatcgctcagtcgtaccgaccgtatggctaagtacaaccaactgctccgcatcgaagaggagttaggcccttgcgctgtatacggctacaagaaagtgtaagcgacaaagtacacacagggtacatctttctgccgaatacggaaaaggggaaaagatagtaccactgcccaaaaaaagaatgcccccaaagttggaaacacaactttgggggcatttatattgccgacttatttagaagcgaacaccgagacccacaaagaagtcatgattacgcaaagaagtcttatccggagcatccttcaacatattaagcaatccatgctcatatccaatttgtacgtaataacggtcgtagctcaaggcagcagacaagcccaagcccaagtcgaaacggttatatccgttatcaccaaaggcatctacagaagccgtaacgcctgcaactttagtcttaatcgttccggcgacaccatatgcgaaatagggacctgcttccaatgaaatagccatgttgtcagcaaagctaaatctcataccggcattcaccggtatttgcagataatgcaagcgagttgtcgtttcacttagtgattccatcttagcacctctcatcgtataggccaatccgggggcgagatagaatccatcattgctaagagcgaactcagcagcagcaccaacacgtaagcctacgatcatcttattgttcacgctcgtgtttgcgact

SEQ ID NO: 54 - DNA (genomic), 3120 bp, PORYPHYROMONAS GINGIVALIS; double-stranded, circular
  misc_feature 1...3120
  hypothetical: NO
  anti-sense: UNKNOWN
ggttccatgccntggggtatcaggacttccaaatttcatcgaataccgacttggacaatatctcgtgggctgccaagacaggtacagaccggatagagcttttacaccgagccgtatgcagccgcctatcataaggacatggctgctgccgtacagccctatgtcaaggcttcggtacacgctcattcgctcggtctcggtatcaatgccggacacgatttgaatctggacaacctccgttactttgccgaacgactgccctatttggacgaagtttccatcggccacgcactgattgccgatgctctctatttgggactggaggagactatcagacaatatcgagaccaacttgcgttataaataaaatcgaaacagtaacaatcacattgataatccaatgaatattccaagcattccctttctgcaaattcccgttcagtcggcggggactcctatcgactcccttgctaccgtcaatactcccgttaccacaccgacagaagctaccctgtccattatggatctggctctcaaaggcggttggatcatgatcgtattggctgctctttcgctcttggccatctacatattcgttcgcaaggtgatggagatcagggctgccggcagagaagacaattcgttcatggagcggatcaaggattatatccacgagggtaaaatagaatcggccatgcgtctttgtcaggacagggctaccccttctgcccgtatgatagccaaggggatcacccgactgggacgaccgatgaacgacatactggtagccgtcgagaataccggaaacatcgaaattggtaagctggaaaaaggactgcctattattgctaccattgcagccggagcacctatgatcggtttcttgggtaccgtaacgggtatggtgcgtgctttcttcgatatggccaatgccggtaacggcggggtggacgtagctctcctctcgggaggtatatacgaagccttggtaacgactgtaggcggtctcgttgtcggtatcgtaacgctttttgcctacaactatctcgtagctcaggtggataaggtcgtcaataagatggaaaccaagactcttgagtttatggatctccttaacgaacccatcaaaaaatgagtctgaaacgtaaaaccaaggtcacagaagtttttagcatggcttctatgaccgacgtgattttcctgctgctcatcttcttcatggtgaccagtacgctcatcgtacccaatgcgctacgcgtatctcttccctctgccaataaacagcctgcccccgaagctcctttggcacggatcaccatttcagaagatatgcgctatttcgccgcttttggtcaggacaaagggcatgaggtcgctttcgaggagatacttcccctcttgcttcaggagcaaagtcgcaatcccgaaatgtacgtagccatatatgccgacgagaatgtcccgtatcgtgagatcgtgaaggtgttgagtatggccggggagaacaagatgaaggtggtgttggccaccaaagcccaaagtaaaaagtaagttcatgcaacaagagaaagtcaaacgcaatgccgttgccatagccgtatcggtgggggcacatgtcgcactgatcaccctcttgttcgtgctgcatcttcgtgctgctccgcgcgaagaaccggaagaactgatactcgtcaatttcggaatcacggagctttcgtccggagctttcgagccggcaccacaggaaacagcatccaatcccgatgtacaaacggaacaaactccaacgcagaaacagcccgtagtcaaaaagcagcaggcaccggccgaatctgatctgcgtcaggacgtagagccggcacctcacttggccaaagccgaaaaggcccgtcaagaggctgaaatgaaacgcaagcgtgaagccgaagaggctcgcaaacgggcagaggctgcggcagaagccgagcgcaagcgcaaggccgaagcaggcaaggctatcaataataatgtggccggagcattcggacgaggcgccgagcaaggcaatacgcaaggttcgggcacacaagccaatggcaatcagggcaatcccggaggtagcggttcttcgtactcgcttaccggccgtactatcgtgggcaatggcggctatccggaaaagcctcgctacagcaaaccgattcgaggaacggtacgagtaaacatcgtagtaaacaatgccggacgtgtgaccgatgcttccatccgtctgcgcggtaccaatatcacggatgctgccgcccagcgagcagctatagaagcggccaaaactactcgcttcaatgccatagcgggtggtggagatcaggagggagtaatcacctatcatttcgacatcaagtaaaaaacataaggaatatgaaaaagacagcattagtatttctggctcccggtttcgaagagaccgaagccgtaggcacgctcgatattcttcgtcggggaggtgtagtcgccgaatttgtttccattacggattcgctctatgtagagggagccaacgggatcaccgtcaaagccgatcgcctgatgactgatttgccgacagtggatgctttggttttgccgggaggactccccggagctgataatctgaacagctgtgaacctcttcgccgtcttctaagcgagcattatgccgcccaaaagcttgtggctgctatctgtgctgctcctttggtattcggtggtttgggttttgtctgtggcagaaaagctacttgctatccgggctttgaatccaaactcgaaggagccgattatacgggtgaagctgccacacgtgacggacatgttattacaggcaaaggccctgcctgcgtctttgcatttgccatagaagtagttcgttacctctgcggtgatcaggtagccgatgagatcgctaccggtacactcttcagataattcgaatatcctataccgcacaaaaagaaagtgtcccggactgcaaggttcgggacactttctttttaggctcctatgcttctcgaagcactcgctcctttatcttttaggagagtcgggggtaaaccgcagtgcagcccagttgttacgtgagcgtgtttccgaaagagtcagacc

SEQ ID NO: 55 - DNA (genomic), 856 bp, PORYPHYROMONAS GINGIVALIS; double-stranded, circular
  misc_feature 1...856
  hypothetical: NO
  anti-sense: UNKNOWN
acgctcgctatgcagatcaaccccatgctctgcggttcttcgttcaagaacaagggcgtacagacactgctcgatgccgtatgtaagttcctgcccagcccggcagatactcccacagtggaaggtacggatccttctgactcgagtaaggtgatagagcgcaagacctctcccaacgagcctctctgtgctttggcgtttaagattgctaccgacccttacgtagggcgtctttgcttcttccgcgtatattcgggcgaattgcctgccggttcatacgtttacaatgctcgttctgagaagaaggagcgtatctctcgtctcttccagatgcactctaacaagcagaaccccaaagaggtgatcggttgcggtgacatcggtgccggtgtaggcttcaaggatattcgtacgggcgatacgctttgcgatgagagtcatcctatcgttctcgaatctatggacttccccgatccggtgatcggtattgccgtggagccgaagacgcagaaggacctcgatcgtctgggtgtaggtttggccaagctggctgaagaagaccccacgttccgcgttcagacgaacgaagattccggccagacggttatcagcggtatgggtgagcttcacctcgatattatcatagaccgtctgcgtcgtgagtttaaggtggaatgcaaccagggacgtcctcaggtttcttacaaggaggctatcaacgatcctgtggagcttcgcgaagtgtacaagaagcagaccggtggtcgcggtaagtttgccgacattatctgtcgtgtggagcctgccgatgccgacttcgaaaggcgaattgcagttcgtggattgaggtgaaggg

SEQ ID NO: 56 - DNA (genomic), 1111 bp, PORYPHYROMONAS GINGIVALIS; double-stranded, circular
  misc_feature 1...1111
  hypothetical: NO
  anti-sense: UNKNOWN
gactctctcgttttggacgtcgctctcgaaagaataccgccgcggacatattcccgggcgcagagagtttccccctgttttcggatgcggaacgagccgaggtaggtacgctctatgtcagacatagtcgccaggcggccgtagagcgaggattggagttcgttgggccgcgtatggccgagatggtgcgagaagctcgctcccttgctgccggcagagacatcatcctctactgctggagaggaggtatgcgaagcgagagtgtcgcttggctgctatccgtagcaggacttcgcatccgtcgtctccgtggcggatacaaagcataccgccggcatttccccgatattctgaagctttacccgtggcgtttcatcgtcttaggcggttatacgggatcaggaaaaacgcccatcctgaacgaactcacccaaatgggggaacaggtgatcgatctggaaggattggcccaccacaaagggtctgccttcggtgccttggggcaagagcagcagccgaccaccgaacatttcatgaatctcttgcacgatgctctctccgcttgtgatccgaatcgtccgatatgggtggaaagcgagagcaagactatcgggcgcgtatttcttccggacgatttctacaaagtcatgcgtcaagctcctttgatcgagctgtctgtcccccgtcccgtacgcatcggccatattgccaaagagtacggcgtgtacgatgcagaggcactggcaaactctttcgagcatatcgctcgccggatgggaggagccgctacgacacaagccataactgccctcaaggaaggacgtctggaggaggccgtatccttggctctcgattactatgacaaggcctatgcacactcgctggctgaattcagggaaagctcctctgctcgactggcagtagaaacggatacacctcacgaaacagccatcaaactactggaactatctcatataaaagggttacaatcatgaaagtagtggatactcgggggaaactctgccccctccctcttattttgctcaagaaagccgttgacggcactcccgtcggagaagaaatctccgtaatgactgacaatgaaacggca

SEQ ID NO: 57 - DNA (genomic), 978 bp, PORYPHYROMONAS GINGIVALIS; double-stranded, circular
  misc_feature 1...978
  hypothetical: NO
  anti-sense: UNKNOWN
gccaataattataaaattcaaacagcctaaacattcttaatgcgatgactactagtaacaagcaatacaagagctnnggaaaaaattacagcgtaatcaaaatacatctcattctgaaaaaaagagaataatacggctgaccaaaataaagaaaggctcaagtggtaatacggagaaaacctatttgcacgaattaagcggtagattgatagataaaacagcaacaacaaaacaagaccaataaacccatgctcagcaagagcgttcacaaactgattgtgtgagaaaactcgcatgccagtcttctgaaaattacgctcaacaacttgagtatacccctgtcccaacagaaattcataaatattaccctcactccatccttctatcccattcacccaaaaagaagtacgtccagatccttttaaatccattccttctgcagaagcattagtatgcacattgcgcccagttatccttgcctgaaactgctcgttggtattatagaaataaacaagagcaacaccaactaagcctatcaaaaatgaaaatttaaccaagtgatgaatagtaattttacgaggaagcattagaataaccagagcaacaagaagcatcaaccagcctgtacggacataggcctgaaaaacagaaattaatcctactacaatcagagaagcattgaaacccttctgaaatgacgtcctaaatttattcagtctaaatccgtttgttagaacgaggattgatgcggcgaagtangangaatcccgcatgaggagctccaaaaattccagaataataaactgccccctcaattccaaaagcatcagcagataaaaagtcttccactggagatacaatccccacaagtactaaaagtgatgcaagaagtacaaattgggctaaggtataaaggaagaattcgagccgatcaactcgattagagaatttaaccaaccaaaaacgaaaaaagagagc

SEQ ID NO: 58 - DNA (genomic), 904 bp, PORYPHYROMONAS GINGIVALIS; double-stranded, circular
  misc_feature 1...904
  hypothetical: NO
  anti-sense: UNKNOWN
ggtccgctgacattcggctattctaccacctatatatatgattttgcaccggatagtaagcgtgctctgatcggtacgctctccacggactggacgcgccgtcctttccgctttgccactatcatggagtacaatatggagacgggcaaggcggatacgcttatcactcgcgatccttccatcgacgcaatccagtatacacccgacggcaaacatctgatcgtaatgggttcggcagatgctttcggcaatataggactgaacctgaaatcgggagtcactcccaattcttacgacaagcaattcttcctgttcgatctctccacacggaaagcaacagccttgaccaagaatttcaaccccagtgtatcggcagggagattcgacagaaaaaacaactactattacttcagggctgaaaacggatcgcgcaagcagctctatcggttgggatctgaaaacccttgagatcagtcagattcagaccggagagggatggtagtacaatggttcggtgtggcagctgataatggtgctgtctggtacagcggccagagtgccaacaatgctgacagactctatcggctcgatgggaccaaaggaaaactcgtatgggatctgtccgccgagaagttggccaatatcgatttcacaccggcacgcgactggaactatacggctccggatggcacagtcgtagagggttggtactacctgcctccgcaattcgatccttccaagaaatatcctatgctggtctattactatggaggaaccagcccgatcaataggacactggaaggacactactcgctggcgatgtatgctgctcagggctacgtagtctatacgctcaatcccagcggtactaccggctatggacaggagtatgcagctcgtcacg

SEQ ID NO: 59 - DNA (genomic), 1047 bp, PORYPHYROMONAS GINGIVALIS; double-stranded, circular
  misc_feature 1...1047
  hypothetical: NO
  anti-sense: UNKNOWN
gggcctcaacaatcgaataaaacggcatttgagaatgatcttttctcttattcttccgtgccggagcaagagttgcatacaaggactaaagataattgcggcatacagagtccatcgggcagattggagccggaaatcaagatcgttcaaatgcctgcgaagcagatcgagagaattacggtgttctatacggatggcagctatcaagagtttcgctcaaacaaagagtaagcctctcttttttcgtaattttgcactcgaatactgcaactcgatttctcgatgaaatacaaccataaactgcgtgtcgcgaccaatacgaagctaaacgacagctatttccttcttacacttgtaccggagcataatgaagtacgattatctctgccggaaataaagcccggacagtttgttcaggtactgactggatgtccaaggggcttttttgcgtcggcctatctctgtttgtgatgtcgattacgaacggcaggaactattccttctggttcaaaaagtaggcaagggtacacgtgctttagcttcattacaagcatccgattcattggatcttctatatccgcttggacaggggtttacgcttaacgatctgccggatggagagtatcgtcctcttctcgtgggtggcggtgtaggcactgctcctatgctctatttggcgcgttgtatcagagagagggggatcgtgccggatgttctgctcggagcgcgttcggcagatctgatcgttatgcaggacagattctctcgttttgccaatctgcattgcaccacagaggatggttcgttgggggtgaagggctttgtcacgagccacccgacccttcgggaaggcgatttttctcatatatatgtgtgtggcccaaaagcaatgatgatggctgtagcatccctggcacgtcaacgaaatatcccgtgtgaaggtctctctggagaataccatggcttgtggtatcgggcatgtttgtgttgtgtggaaaattcnaaagaaggcaatctttgcgtctgtaccggaagaccggcttcaat

SEQ ID NO: 60 - DNA (genomic), 612 bp, PORYPHYROMONAS GINGIVALIS; double-stranded, circular
  misc_feature 1...612
  hypothetical: NO
  anti-sense: UNKNOWN
ggcgaagagcatgttcgggcgtacgctccagtcctgagctttgccgtcctgaacgtaatcgaagagatagttgtagcaattcagaaacgtatcggggaaggatctttcgatccggctgatgatttcgccgatctccggtttttccccattgagttctcgttcgaagcagagggcattgtaccagagagcattcaattcgacgagatagccctcacgggggatgacggctttgccattcagtttggcatccatccaacttaacgggaagcctgtgcctaagacgtagagaagcccattttcacgaatttgtgccgtcgggtgctgggcggacagataataagataccacttcgctgacgaaggagccgaatctcttggctgcttccagaccgttgcggcgtgcatactgctggatggcccaaatagcccaaatcccaacgtccggttcatgcagcccgtgtatggtgtcgtcatcttcatgcagtcgcatgtagcgttccatcgccggaatgacggtattgacgatgccgttcgaatcgcttccggtgcttctacacaccagagtacagcccggtaagtgccacgaacagatcgcgagctcgaacgtcgaacc

SEQ ID NO: 61 - DNA (genomic), 669 bp, PORYPHYROMONAS GINGIVALIS; double-stranded, circular
  misc_feature 1...669
  hypothetical: NO
  anti-sense: UNKNOWN
cagtattgcccaatgggttgatgagcgttacccctttcaatgtcagcggatcgacagagaatcgcttcgacaaagattcgcgttggtggagtgcgccttattcggccgacaatagttactgcatcggtttcagccatgtgaatctgagtggagtaggctgtcccgaactgagtggaatactgctgatggccacttccggcacattcgatcctgattactgctgctatggctcttcgctcagtcgagaatatgcgcgcccgggagaatacaaggctgtattggacaaatacggtatagatgcagccgtgaccgtaaccgagcggactgctttgaccgaatttgcttttcccgaaggagaaggccatatcctgctgaacctgggacaggccctaagcaatgaatcgggagcctctgttcgattcttaaacgactccacagtcgtcggcagcaggctgatggggacgttctgctacaatccgcaagcagtttttcgtcagtatttcgtacttcaggtgagtcggcgaccgatctctgccggctattggaagaagcagcctcctatgacagtggaagcccaatgggattcgactgcagggaaatatagcagtacgacggctacagcgtgagatgagcgtgatgacatcgtgtccgatctcgtcaactggatca

SEQ ID NO: 62 - DNA (genomic), 910 bp, PORYPHYROMONAS GINGIVALIS; double-stranded, circular
  misc_feature 1...910
  hypothetical: NO
  anti-sense: UNKNOWN
ggggctgatggaatatgtttttcccgaactcttagccctcaaaggagcagaaacgcgtgatggcatcgggcataaggacaatctcactcatacttataaggtagtggacaacttggctcggcacagcgatagtctttggctcaggtgggcagcattgctacacgacataggcaaaccacgcactaaaaagtttgttggcggacagtggacatttcataatcacaactttgtcggagccaagatgctaccctctctcttcaaacgactccgacttccgctggatgccaaactcaaatacgtacaaaaactcgtagatctgcacatgcgtccggcagctctggtggacgaaggagttacggattctgccgttcgccgtctgctcttcgaagccggtgatgatatagatgatctgatgatgctatgcgaagctgacattacaagcaagaatcccgacaaggtgcgcaagtatatagacaactatgctttggtacgtcataagtttaaagaaatagaggagaaagaccacgttcgcaacttccaaccaccgatctccggcgaagagattatgcagaccttcggtctaaaaccatcgcgccacgttggcaccatcaaggaggcgatcaaagaggccatactcgacggggctatccccaatgactacgaagctgcccgagttttcatgatcgaagcagctgcttcactcggtcttcaccccaaaaaccaaacatcatgccacagcgtatagacctgcgagtgcgccccgaagaggctactgacgaacaaatactgcgcaaacatgtagcgagacagacaaaaacagatccgaccgacatacatactataataatcagacgtcgcagtattgacgctcgacaacgacagtatacgtcaattgggtctgaagctatag

SEQ ID NO: 63 - DNA (genomic), 670 bp, PORYPHYROMONAS GINGIVALIS; double-stranded, circular
  misc_feature 1...670
  hypothetical: NO
  anti-sense: UNKNOWN
cgcaattgatcgggatggctattctgattcttctcgttctctatgccaatggcaatgacttgctcagggcttttcgctgacagaccgctatgattcggatggagacttacccccacaacttcgaggagaaagtgggtttcgatgagattcgtcgccttctcatcggccattgccatagtccgatgggcagcgatcgggtaatacagatgcatgctcttgcaaggcataacgaagtcagccgcttgcttgccgagacggaagaaatgcanattatcctgagagaagacgacttgtttcccgatctccgtctggccgatgtgcgagaagcactaaaccgtatccgacctgccggtacctatctggaagagcgagagttgcaggatgtggctactgctctgaggacaatcgaggctctcatccgtttcttccatgtgggggaagaagaggagggtaaggatacaccgtacccccacctccaaactcttttgtccgaggtcattgcctttccggatctggagaagcgtatcagcagcttgttcgatcggttcgggaaaatgaaagacaatgcctcgcccgaactgatgaatatccgtcgcgaactctcttccatagagaaaaatatctcgcgcactctccaaggcatccttcgcttggctcagtccgaaagctg

SEQ ID NO: 64 - DNA (genomic), 1077 bp, PORYPHYROMONAS GINGIVALIS; double-stranded, circular
  misc_feature 1...1077
  hypothetical: NO
  anti-sense: UNKNOWN
cgggggattttcctcctctttttgggcttctgccagcaatgagggatttaaggctatgcccaatcccacactgccgtacccggtcacactcgctgacgaaggttatcagggtcgttgcgtgcggatgcttacccgacccgggatcaaggtatacggcatgggtagttatctggtggcggcatcgcttttttccggtaaggtcgatgtatcgaaactgatctctgccccattggaagccacttacttcgggcacagagtacgccagcgtccgattcggctgcgaggttactatcgatacaaggccggaagcaaatatatcgatggcagcatagggccggatgccgtgctggaaggcaaagaccaatgcacgatcgccggcgtattctatgaagtaactgaagatacgccctacttgaatggcaagaacctctatactgcaccgtccatcgtatctattgccaaagtgatagcaaatgatacggatgggtggcagccgttcgatctcacgttccgatccgttggcaataaagtcgtggacttggccaacaagcagtaccgcttggctctggtcttttcgtcttcatcgcgtggagacgagtatatcggctccgtggatagcgaactgcttgtcgatgaagtaacccttacgctgactactttacccgaataaacgttatgaaccggcgatattttcttttgaatgcttgcttttggagcctctgcttcatcctgtcggctcaggagtcgaacgcttctgtccggccgtcgctttgggagttttccagcagagtgggtatgcatgtgggagcatccacaccggtacccgtaccccaagccatggagcacgtctacgcgtggtatccgcgactgaatccgatggtgcaactgagtgcttcgcgtcgtttgcttgccggcagtccgtgggctgtgaacgtgggtatagccgtagagaaaaaaggcatggaagctactacacgagtgaaagatatgaaagtagctatcgtgtcggactcgccttatgcccggcaaccctgatgaagaatatccgggactattcaccggcgacaacaatacgga

SEQ ID NO: 65 - DNA (genomic), 590 bp, PORYPHYROMONAS GINGIVALIS; double-stranded, circular
  misc_feature 1...590
  hypothetical: NO
  anti-sense: UNKNOWN
tcccccatagaaatctcaaacaaccgcaaagtctttctgaccaatcaattaggggttgtaaacatcactgacgggatggaacctccgattattgccggagtctctgcttcctatggatcttccgtccgggtgtatggtcatgtctcacagcggtgggacatcataggccattgctatttggatatctacccaaccaattgctatccgctcagcacgaaacccgttgcaggagacgatgaggtttttgtcaaacaacaaggcaggcaaatagagatcgatagcaacagccccatagtccaagtggtcgtatacgatcttgaggggaaaagtgtttttcgcaaaagaatgaccgaaaacgcttataccctatcctttagagcacccatgctcggctttatgaccatcatgatcgaaacacaaaattcgattatcaataaaaaacttaatgttacacagctatgaaacgaataattttattactcagtactctctgcttctttgtatcaccttatgtacaagcgcagaatgaaggttcagatgcttattatcaacaaatgtttgaactaatccgttccgactttcgaacggat

SEQ ID NO: 66 - DNA (genomic), 886 bp, PORYPHYROMONAS GINGIVALIS; double-stranded, circular
  misc_feature 1...886
  hypothetical: NO
  anti-sense: UNKNOWN
gagaatccaaaagcgtaatagaaaggtatacaagcaaaattaggcttcaccggagttggtcttttttcttacatttgtggactcaacaactaaatgccctatatatgctacgacttcatataacatcgacaaacagtaaggccgattttgctatcccacatacccactctcccatcgcgaaaggagagaaaagaacgcttatacctatgacgaacaagcaggaataaggctatcaatagccggacaaaagcataaggcacgcacccgattcgaggctgaatcaggtgcgtgcctttcttttatcgcctgtcgaaagggctttcttcatctacgatctatatataaatggtatgacaatctatatagatatggaaatcgatttatatataaattgaaaacgattaatatacagatcgaaaatgatttatatataaatcgaaaatggttgatatacaaatcgtttttccatttcttagaaacccgaatccgagctaaagaagttcgttttaccaccttttggggttcaaaaggctcttactttcaggtgcttatttagaatcattcaaaactcatcttcgttgttgaaaacttttttggtgcgtatttttcagtgtttgccataagctccggagagcagagaaaaaggcctcccacgattgattgtcttcctccccctatcctacccccaaaaataccgctgtagctacttatcgatagtatgagtgcggctccgctcttgatgccggcagcagccgaaaaagggaatcgtgcttcattatttattacttttgcgcgataatgttctcgtgcagacgcggccgatgaccggatcgtgcacaggagaagcaaaaacattcttacaggaccaagcgtacagtatggaaat

SEQ ID NO: 67 - DNA (genomic), 765 bp, PORYPHYROMONAS GINGIVALIS; double-stranded, circular
  misc_feature 1...765
  hypothetical: NO
  anti-sense: UNKNOWN
cgatcttcttccagtatgtaggccggagatgctatgtcgtggtattttgccatctcttaggattagttctcattcggtatcagttccaagaacagctcttggagctgtgcctcatcaatgacagagggggcgtcgatcatgacatcccgaccggcattgttcttcgggaaggcgatgcagtcgcggatgctgtccaaaccggcgaagagcgatacccagcggtctaagccgtaagccaatccgccgtgaggaggtgctccgtacttgaaggcgttcatcaggaagccgaactgctcctgtgctttctccggcgtaaagccgagcaactcgaacattttctgctgcagggcactgtcgtgaatacgaatggaaccacctccgacttcgacaccgttgatcaccatatcgtaggcattggcacgcacggcacctggatcggtatcgagcagagggatgtcctccggcttcggactggtgaaggggtggtgcatggcgtagaatcgcttcgtttcctcgtcccattcgaagagggggaagtccacgacccagaggcaggagaatttattcttgtcgcgcagaccgagctgagagcccacttcgaggcgaagttcgcacagttgcttgcgcgtcttcatgaggtcgtctccgctgaggatcagaatcaggtcgcccggttctgcctccatcgtccggcgaagctcttggagcgtctcttgtgtgtagaatttgtccacgctgctcttgacgctgccgtccgattccaca

SEQ ID NO: 68 - DNA (genomic), 541 bp, PORYPHYROMONAS GINGIVALIS; double-stranded, circular
  misc_feature 1...541
  hypothetical: NO
  anti-sense: UNKNOWN
cctgaaagtaatatccggatcaaggggtgtgcagaggagcatgtcatccatgtcgcacaagccatcgaacatatctaccagatcaccgaaacgatcgctattgaggcatacggcaagggcgttgatggtgaagtcgcgacgacgcaaatcatcttccagcgtaccatcttcgactatcggcttacgactatcgtgtcggtaactttccttacgggcacccacaaattctatctccagatcaccatgctttacttgagcggtaccgaaattggcgaaaacggataggtgagccttccgtcccagcttcttggctacagctttcgccaggtcgataccgcgccctacggctactatatcgatatctttggaaggacgattcaagaatatatctcgcacatatccacccacgacataaggtttccagtcccaactgatctgccactttctgcgataagacggaatatcgggatgtcgatttactaagaattaactctttgtctggcattctaaaaaatcaaggaatggattggccgacaaggtc

SEQ ID NO: 69 - DNA (genomic), 467 bp, PORYPHYROMONAS GINGIVALIS; double-stranded, circular
  misc_feature 1...467
  hypothetical: NO
  anti-sense: UNKNOWN
cagcttggaggctccgagtccgcgctgaatctgaatggtactggcttgattcatcagaccactccaattgctccaatatactttcccgtcttccataccattgacaggaactccgttgatgagtacaccgaagttgtaagtgtcgaatccacgcacattggtacgaccatcaccgaaacctccgcttccttttgtcgtataggtagagggagtggatttaaccagttcgggaaattcgacattcaacgatgctgcctgaatatcagccacacggatattggaaacgggtaccggcgtcatacggtctttgggcaccacagaggctattacctgaatctcatccaagccgatggcctggggatcgaggagaatcgtaccgaggtcttcttgagaacctctgcctatagagcgagttacggtagcataacctacgcaacggaaagttaagacagatttggccggtactt

SEQ ID NO: 70 - DNA (genomic), 5410 bp, PORYPHYROMONAS GINGIVALIS; double-stranded, circular
  misc_feature 1...5410
  hypothetical: NO
  anti-sense: UNKNOWN
tgtccgggtttcttcttaggcttcggctccacacgtcgtagtcgaaggccagggctgaagaccccgggcggagcttgccgcgtgcggggatgctcttgagctctgccgaggggatgaagacgagcctgtgcttctggatctgatctacagagaaattcttggggtcgtccaattgtttggaaccgaacgagaggcggaagctgcccagctcgccgatgcgaaccgtcttgccgttgggcagctcctcgctgaggatattgacgaggcggtccaggatgcctttgacgtcggcggaggtcagagccgactcctcggctattcgcttgcagaggctgtggaaggttacagagtcttgtgccgccggctgggcataatagatggtctgtccggctttggggccgatcttggcgacagactttttgatcacatactttagggacataacttgcttattattagtttcttgttatttgatgaccactcatacccgatacatccctcaagtcctccgaaaaaaaacgtctggacgttcggaggaaaacgtctagacgttccgaataaaacgtctagacgtttcgagcaaaaggtctagacgtttcgggcaaaacgtctagacgttttttcgaggggatattgcagacggccacggccacgtcccggcgtttcccgggggaggctctcggccttcctcccgtgaggtgcgtcggctcctcccgcacgcggctgaccgagggggcggccacgacttgcgggggcggtctgcaaaccgcggcaaaggtacccaaatagttcgattcggcagacagtaaaataaatactcttgtcgtgtcgtttatggagacgaaggggggcggcgtcccgctctttgcgatcgactctccgcatcgcccccgtgggccgtagcatccgcaggcgcagccggcctcggcgaataaggcggagggagtaagaccatcattcgatttatttcttacatttgcacgacggaaaacgaaatagacacctattctctatcctttcgtcctgcggtatcgagtatcctgacagtctcattccgagatgccgtatccccctatcaacacttatcatatttctaaaaagctcatcatcatttattatgcagaagtacacgatcgtcgatttgaacgaaaaggctgaagctgaactcgctgctatagccggcgagctgggtattgccaatgccggctcaatgcccaaacaagaacttatttacaaaatactcgacgagcaggctatcagtgtagccggcgtccggaaggaaaaacaaaaaacgacggaagaccggcacaccgaaaggcgcaagccgggtcgtccgcgcaaaaacgccgaggaggaagctcccgaaagcgaagacgtcgcagccgctcctgccgagccgaacgacgaggaagctcaggccaaacgcaagcgtggccgccctcgcaaagcggcggaagagatagcggaagagacccgggaagatgtgcagcagctcgtggctctggctgctgcagaggagacaaatgcaacggagaaggagagtgccgggcggaagccggcggcgaaaacgtccaccgcatcccctgccaaagcccctgccaaagcccttccccgtccggcggagaccaccccgcgcgtggcaccgtctccccctcccacgacgcccgtgagcgagccggccaaggacgatgccaagcccgagacgcccgctcctccccccgccatcgagtccatcaccacgactcctgctgccggagccgtcgatgagggcggtgctcgccgcctcgtattcaggcacaagaacagctcctcggtattggatcaggtgctgccgtacagctctccccagcccccgcagaggcccaaaccggccggtgctccggtcggcagcagcccgatcaggcagcgacaggcggccggcgtgccgactccccgtcgcgaacctcagcaacctctctacaacttcgacggcatcctcgagtgcatgggtgtactggagatcatgcccgacgactacggattcctccgctcctcggactacaactatctgtcctctccggacgatgtgtacgtgtcccagcagcagatcaagcacaacggactcaagacgggcgacgtcgtggcaggtactatccgtccgcccagagagggggagaagtacttccccttcgtgcagctgcggagtgtgaacggtcgcagccccgaagagatccgcgaccgcgtgcccttcgatcatctcacacccctcttccccgaagagaagttcaccctcgaagcaccgggcatccgtgccgtaaacgataaaatatccgtccgcgtcgtagacctcttcgcccccataggcaaaggacagcgcggcctgatcgtatcgcagcccaagacgggtaagacgatgctcctcaaggacattgccaatgccatcgcagccaatcaccccgaagtgtacatgatcgtcctgctcatcgacgagcgtcccgaagaggtcaccgacatggcgcgaagtgtgaacgccgaggtcatcgcttccaccttcgacgagccggcagagcgtcacgtgaagatcgccgagatcgtcctgaacaaagccaaaagaatggtggagtgcggtcatgacgtagtcatcctgctcgactccatcacccgcctggcacgtgcatacaataccgtacagcccgcatcgggcaaggtgctctccggtggtgtcgatgccaatgccctgcagaagccgaaacgcttcttcggtgccgctcgcaacatcgaaaacggcggtagtctcaccattctggccacggcgctgaccgacacgggttctaagatggacgaggtgatattcgaagagttcaagggtacgggcaatatggagctgcagctcgatcgccgcctgtccaacaaacgcatattccccgccgtggacatcatgtccagcagtacccgtcgcgacgacttgctgcaggacgagaccacgctgaaccgtatgtggatcctgcgcaagtacctctccgacatgaatcctgtcgaagccatggagtttgtgcgtaagcagctggagaatacgcataccaatatggagttcctcgcctcgatgaacaactgatcagtttcctgccgccgcctcctctccgacaagagaggaggcggcagcggacaggactctgagtgacgagccgccctctatccggatgcagaccggcagacgagggggagggaagtcgaagagccgggcatatcgtctttcggtcttctccgtgcggcttacggtttcgtcctgctataccttattattataagtatcaatcctcaatattcgttacggcagcattcatgacatcttcacgcctctacggtcttgcggtcggtatactgtcgtccgccacattcgggctcatccccctgttcacgctgccggtttcggctaagggtgcttcgttcgagcttattctcttctatcgctttttcttcgcagccatcgccatcggtatactgcatcgcctctcgggcggcagcttcaaagtcagccgtgcggatatagggccgctggtattgctgggcttcttgtatgccggcacggcacttttcctctttcacggctatggctatatggccagcggtgtagccaccaccatccacttcctctatccgctgttcgtcacggctctgatgcttcttttctttggggaaagactttcgcccgtgccattgacggccattttcatcgccctgataggcgtgggcctgctgatgggccttacgggagggggcgatcgggtagggcttaccggctttgtgatagtcgccatctcggcgctttgctatgccctctatatcgtctttgtcaatcggagccggatccgaatcatgccgggacggcggctgacgttctacgtcttcgtcgcagccgcaggtttttgcctgatcaacgtcctggtcagacagggcgaagtggctcctcttcccgacgcggcttcatggggcaatatcctgctcttggctttggtgccgacggtaatttccaatctggctttggtagtggctgtacgcaacatcggctccacgctcacctctgcgctgggaagctatggagccgcttacgtccggtattggtaggtgtgtgggtcttcgacgaggtgttgggggcctccgctatagtcggtatgggctgtatcctcatagccgtcgggcttatcgtcttctccgaaccgctcgaactgatgctccgcaggaggagacgatagctgccgttcgctaccgttcgtctgctgcgatattgctttcggccaccaagtacaggggccttgcgactatatttttattgatcttggatatataggtaccgatcaccccaaggcatatcagctgcactcctcccaagaacatggagcttacgatgacggaagtccatccgctcaccgtcttatccagcaggaagtgcgagatgagggcatagacgatcacgaataaggagagcaaagaaacccaggcacctaattgggccacccattcaagcggtctgctggaaaatcccgtgatgccgtcgatggccaaggcaagcatcttcctgagcggatagttcgtttggccgtatttcctttcgtctctgtcgaactgcacccctgtctggcggaatcccatccaggcgatttgtcccctcaggaacttgttctgctcgggcatctctcgcaggcactgcacgatcttccggtcgatcagccggaagtcgcccgtatccagcggcatatcgatagacgtgatcttgcgcatcgtccggtagaaacctttggccgtcgctttcttgaaccacgtttcgccttcgcgatgcttccgctgtgcatagaccacttcgtaaccctcacggtatttcgcatacagttccggtatcaattccggcggatcctgcaagtcgccgtcgatgatcaccgtagcctttcccctcacatggtctaatcctgccgacacggctatctgatgaccgaagttgcgactcaggttgatgtagaagaaacggtcatcacccttgcacaggctgcgcaatagctccatcgaaccatcgcggctgccgtcattgacaaagatcagttcgtagtcctccgttatcgaagccgccgccgcactcaaccgccgcaccagctcgggaagttccctttcttcattatagatcggcacgatgatggaaagctccttcgtataagtcgtattgacatccattagaattgacgtttagattgttttcggcactctcaggtgaaaaatgaagtgcttaggtgacaagggtcaggaccgttcctttgtccgcttcgggatggaaccagcggatcgtactgtcgcgtctgaaccatgtcatttgcttgcgggcatatacgcgactgttgcgttggatccgccttacggcctctgcccgatcgatcgagccgtc

SEQ ID NO: 71 - DNA (genomic), 876 bp, PORYPHYROMONAS GINGIVALIS; double-stranded, circular
  misc_feature 1...876
  hypothetical: NO
  anti-sense: UNKNOWN
cctgatactcttgctattcagtgccctcggtgtggtcgcaacccgtattccacactttttcctccgcttgtccaatgccgttttgtatggtcaggagcgagtctttctggtccgtatgccacgctatatcagttatcggctttttgtctttatcggccgtatccaaagcacattgttgctctcgatctgttgtttcctcatattggacgacaaggggcaactcaccgatttcgatttgtgggaaagcctttttttcttggctttgctcttcttcctgttctgttttgtcttttggctgtggaggatgttttatgccttgtggtgctatttctttgccgatcgtgagactaagatgatctggagagggggttatgcgttgctcgaatggatgtgggggatgctcctttttcccgttgcggtcatctatctttatatgccacaattatattggctaagctacttgttaccagctattttcgtgctgtggagattagtgcttatcgctaaaacgatacgattcttctcgatcagggaagtaggttttttccacctttctttgtacctttgtgcccacgaaattttaccgttggtttacttgattgccttattggagtggtcggtaaacaataaagagataatggctctatggcagtaaaagtaaagaagatactcatttcacagccacaacccgtagcgggtaggtcgccttattacgatattgctcagaaacatggctgtgaggtcgtgtttcgtcctttcatccaagtagaagtcccgtcagtgcgagagaatttcgcaatcaggaaagtgaatattctaagaccattcggccatcatcttcactggaccgtaccagctatcgaccatttttcagtt

SEQ ID NO: 72 - DNA (genomic), 676 bp, PORYPHYROMONAS GINGIVALIS; double-stranded, circular
  misc_feature 1...676
  hypothetical: NO
  anti-sense: UNKNOWN
cgggggatttctttgtggagtcgccgatcatcttgctggcggctattatctggttcctgaagatatatgagaacggcaggtattgcacctttccgcatgccatcgagtttctgaacagaccttatgcgcagatctttccgattctgacttcttacgatgagctggccaactatctttcaccctttatggacgcatgggaaggcggcgcacaggatcaacttcagggacagatcgcttcggccaaagaatcccgctttcgaggatgatttctccggcactttactgggtaatgacgggcgatgacttctcgctcgacatcaataacccgaaagaaccgaaaatcctggtggtgggcaacaatcccgaccgacaaaatatctattcggcggcactcggtttatacaacagccggatcgtgaaactgatcaataaaaagaagcagctcaaaagctcggtgattatcgatgagttgcccaccatctacttccgagggctggataacctgattgctacggctcgttccaataaagtggcaagtctgtctgggctttcaggatttcagtcagcttacccgcgattacggagacaaggagagcaaggtgattcagaacacggtgggaaatgttttcagcggtcaagtcgtaggtgaaacggcccagacgttatcggaacgctt

SEQ ID NO: 73 - DNA (genomic), 404 bp, PORYPHYROMONAS GINGIVALIS; double-stranded, circular
  misc_feature 1...404
  hypothetical: NO
  anti-sense: UNKNOWN
catcggccatcacacgagtgatgagcaaaggagcggtaccgctgttgcgaaacttgaagctatgccctaccgatcctttttcttccggaatcaggccaaagttaaaggactgctcctcgacctgtatttccggactctcctgagctgtcagcaacagaggagtcaataggaaaaggaagaagagcagccctcgaaatgtactgacgatcatacgccttgtactacttgcagagctatgctatttattctacaacccctttgatgcgtagcgtaaaggtaccatccttaccattgctgtacacggctatggtctttacgaactgacccggacggccggcaggattatatgtgacgtctattttgcttgtctgacccggagcgatgggctctttgctaaactgggg

SEQ ID NO: 74 - DNA (genomic), 2396 bp, PORYPHYROMONAS GINGIVALIS; double-stranded, circular
  misc_feature 1...2396
  hypothetical: NO
  anti-sense: UNKNOWN
ggtaaatattatttgataatccggaagaagttcggcaagaaaattattcaattcttcatccagattttccagcagaagccgaatccagctgaatcagttcgtcgtcgatgaagagcaattcctcgataatcgtgaaatcctcctgtgtcagagccaccgagaaggggcgtacaaattggtctttgtcgaagaatcgggctgcatgcagccttttgactgcagcacgaagctcctgcctcattgcggacggaatctccgttcgtccctcttggatccaatcgtatatgaccacacgatgaagttcttcgtctttgtcgttgaatagctgtacttcccccgcagccggatctatttggacgaaaagatcactgatggctatcggtgccgttttggagctgtcggggtgttcgatcggtgtgcggaacaggcgttcgagctgaatctgtacttcgttgggtttcattgttggctaaagagattgtgtatggggtttatttggtcgattgcaactgattcagactgtctcgaagtgtggcgattcgcgcttcggcatcgcttttcttcttttgctccagttctatgacagcttgcggagccttggccacaaagctttcgttgccgagcttcttcatgaccgaagcgaggaatttctcctgataggccagttcgtcggacaacttcttgatctcctctcccacgtcgatcaatgcgcccatcgggatggcgtattccagtgtaccgatcaggaaagaggtagagccgcttgtcttttcttccactcggttgatggcttcaaggttgcccattttgatgatgacggcatcgaaagaggcatcgtgttcgtttcctgcttcgagcgtcagcttttccttgaaaggaatgttcttgccggtgcggatattgcgaatggcggctatgatctcccgtgtacggtcgaaggcttgcaggaagtccctgtccgtctcatgcgcatcgggcaggaggcagagcatgatggtctcgccatcgtgacgcggttcgagtgcatgccatagctcttctgtgataaaaggcatgaagggatggagcaaacgcagcagctgatcgaagaatccgatcgtactgccgtaggtcttcgcatccatcggctgaccgtatgccggcttcaccatctccagataccaggaggagaagtcgtcccagaacagcttgtaaaccagtgtcagtgcctcgctcagacggtacttggagaagagatcgtccaactccgtcttcacctcatcgagacgatacccgaaccatttcacggccagagccgaggcttcgggctgcgtggacgtttctgcctgctgccatccttttacgaggcggaaggcattccatatcttattgcagaagttacgtccctgctccgagagcgattcgtcgaagagcacatcgttgccggccggagcggccatcatcagtcccatgcgtactccgtcggcaccgtatttctccatcagcatgatcggatccggtgagttgccgaggctcttggacatctttctaccctgaccatcgcgcacgataccggtcagatatacgttgtcgaagggtttcttgccacggtattcatagcctgccatgatcatacgggctacccagaagaagagaatgtccggagccgttacgaggtcgctcgtgggatagtagtagtccagctcttcgttctccggatccatcacatcgccgaatacgcttatcggccatagccatgaggagaaccacgtatccagcgagtcgctgtcctgtcgcagatcctctactgtgagcgagtccgatcccgtttgcttacgtgccagttccacggctttttcggccgtctccgccactacgatacttccgtccggcaggtagtaggcagggatacgatgcccccaccagagttgtcggctgatgcaccagtccttcacgttctccatccagtggcggtaggtgttcttgaatttggccggatgcagtttgatctcgtcgttcattacggcatcgagagccggtttggccagactttccatctgcaggaaccactgcatcgagagcttcggttcgatgggtacatcggtacgctcggagtagcctaccttgtttacgtagttctccactcgctccatcagaccggcatcgatcagatcctgttcgatcttcttacgcacatcgaatcggtccataccggcgtacgggccgccatgttcgttgagaatgccgttgtcgtggaatatgtctatgctttcgagccggtgtttctgcccgagcatatagtcattgacatcgtgtgcgggtgttactttcagacatcccgtaccgaactccatatccacatattcgtcttcgatgatgggtactgcacgccctacggtgggcactatcacccgtgg

SEQ ID NO: 75 - DNA (genomic), 618 bp, PORYPHYROMONAS GINGIVALIS; double-stranded, circular
  misc_feature 1...618
  hypothetical: NO
  anti-sense: UNKNOWN
cccggtgattatgatgaattgcttgtttcttcggtggtatcggacaggaaggagaggaccattggattctgccgatagcgacgacaagattagaaaaatatgctgacatattctattcaaaagtagtgccccgatcggtaaggtcgtcctaacagctcagtaacgtcgtcctaacagatcggtaaggtcgtcctaacaggttggtaacgtcgtcctaacagctcagtaacgtcgccctaacggctcagtaaggtcgtcctattccgatgtgagggtcatcccttctgcttatatgggttatttgtgcttgtaggaagacatgccggaggtcgttaccttatcattcgaagaggctccgtaattttcgagagaggatatgccggagagatctccccgtacagactcggaagcattgatcttcaccgatgccgtgccactgacggatacttcggtacgttgggtaatgaaatcggatgcatcacaaccaacagctccgctgcatgagagcgtgaactcctcgccggagcctttcagtttgataccggaagctcccgaagcgtttatatccaatgctctgagacggccggtgaggtttacagaagaagcttcccgacaggt

SEQ ID NO: 76 - DNA (genomic), 3315 bp, PORYPHYROMONAS GINGIVALIS; double-stranded, circular
  misc_feature 1...3315
  hypothetical: NO
  anti-sense: UNKNOWN
cgcaatcggagtgtttttggctcgtaagaacaaaagcaacagcttcgcggatattgattcgatggatcaacatcgaaactccatggcttcatgtcgggggatagcctccatctgaaaaaattgaaactcgccctatatcgaatacagatttataattgctaaacgacaaaaattgcctctccttttgaccgatgcctgctccttactgtttggctattatcgagagaccttgcaaaaggctcatgccacagaagaggggaaatatgaaactacttgtgatttacggatttgtactatctttgcggacgcttaattcggaatcaaatactactataataaagaatcaagaacaatggactctaaaatccaggaactaaccgacaaaatttatcgcgaaggtgtcgaaaaaggcaacgagcaggccgcgaaaattatcgctgaggctgaggccaaaagcgcagagacgatcaataatgccaaggctgaagctgaacgcattgtgagcgatgcaaagaagaaggcgacagaatttcagcagaataccgaatccgagttgaagctttatgctggtcagatgctggagtcgctcaagagtaccattgtggatcaaatttccggagagatcgtttcggccaacgtaaaagcggcatcgaccaaccccgaattcatgcaacagatgatgctcgatatggccaagaattgggcttcgggcgagagcatcattatctctacacaaaacgccactgcacttcagtcctatttcgaaagcaatgccaaggacttactcaacaataaggtgacgatcaaagaggtgaacaaccaaccggtggcctatactatccagcccaaagatggctcatacaagatagaattcggtgaggaagagttcatcaatctcttcaagagtttcttgcgccccaggctggtggaaatgcttttctaagtcatggccaaatattacgccactgtagccggtctgcccaacatcactgtggaagatcggaaattgccgtttacgtccttgcagtttctgcaggagcttaggcctatcctgagtcgaacggatagcaagctcttcgatctcctgctttgggagcaggagaatcagttccttcttcgctatctggaggacagcgaaaaggccaaggccgaggagtcccggccgactcttcttctcttatgatacgctggatggcatcatagctgcctatcgggagaaacgtgtcatgccccgtatggattcgttgccggagcatttccgcacttttttgtcggaaaagctgactgagatgtttcgcgaggaagaagaaggagacgttggacaaatgtccctgtcggacactgaagccgaagaaggaaaagcacgcctgccaatctccgacgaagatcgtctggccatgtactattatgaatatgccatgaaatgcggcaacgacttcctggaagaatggtttgccctgaatctgcatatcaagaacatcttggccgcgatcacgtgtcgcaagttgggctggaatccgatcaattatattgtcggtaccggcgaaatagaagacaaattgcgtacgtcacgggctcgcgacttcgacttgggcgaagaactgccctatctgtccacactcttttctgtcggtgaggagacggacattaccaaacgcgaacgtctgcttgatgtgattcgttgggagtggctcgaagagtcggtattcaaccgcgtattcaccgtagagcgtttgctctgctattatttggagctggcgatcatcgagcgttgggtgaagttggacgaaaagacgggagaggagactttccgccgcatcgtcaagactctcaaacacgagagcgcagagtctttggacgagttcagaagaaatcaaaagaaataaatcaagataatggctacaaaaggagttgttaaggggattgtgtccaacctcgtgaccgtggaggtcgacgggccggtttcccaaaatgaaatttgctacatcgatgtcaatggcaccaagctgatgagcgaggtgatcaaggtgatcggcaaaaatgcttatgtgcaggttttcgaaagtactcgcggtatgcacgtaggagatgaggcagagtttaccggcagtatgcttgaggtaacgctcggccccggtatgctttcgaagaactacgacggtctgcaacacgacttggacaagatggacgggatcttcctcaaacgaggcgattatactcccgctctcgatgacgacaagctgtgggacttcaagcctttggccaatgtgaacgacaatgtgatcgcaggctcatggctcggagaggtgacggaaaatttccaaccggacaagatcatggtacctttcgttttcgaaggcaattaccaggtgaaaagtctggccaaagccggttcgtacaaagtgaaccatgtgatcgctgtggtaacggatcaggacgggaaagaccacaatgtaaccatggtgcagaaatggccggtgaaacgtgctatcacttgctatcgcgagaagccgcgtcctttcaaactgctcgaaacgggtatccgtatcatcgacactttcaaccccatcgtagagggtggtacgggatttatccccggtcctttcggtacgggaaagacggtgctccagcatgctatctcgaagcaggcggaagccgatatcgtgatcattgcagcctgtggcgagcgtgcaaacgaggttgtggagatctttgcggaattcccccacctgaatgacccccacacgggacgtaaattgatggaacgtaccattattattgctaatacgtcgaatatgcctgtggcttcgcgtgaggcatccgtatatacggccatgacgatagccgagtactatcgctccatgggccttcgcgtgctgatgatggcagactccacttcgcgttgggcacaggctctgcgtgagatgtctaaccgtctggaagagcttcccggaccggatgctttcccgatggacttgtcagctatcgtagccaacttctacgctcgtgcaggatacgtttacctgaacaacggttcggccggttcggtaacgttcatcggtacggtatctcccgccggtggtaacctcaaagagcctgtgacggaaaacaccaagaaagtggctcgctgcttctatgctttggagcagaatcgtgccgaccgcaaacgttatccggctgtaaaccccatcgatagttactcgaagtacatcgaatatcccgaattcgagagctatatatcgaaccacatcagtgcagactggactactaaggtgaatgagctggaagatccgcttgcatcagggtaaagaaatg

SEQ ID NO: 77 - DNA (genomic), 1189 bp, PORYPHYROMONAS GINGIVALIS; double-stranded, circular
  misc_feature 1...1189
  hypothetical: NO
  anti-sense: UNKNOWN
ctgaatgtgtataaaggaatatatcattgagccatttatatctttcattatggagtagtaatgttcctatcattacatgacggagcataaattcttttttgtcttgtcttaatgtatcattagctacaaagcgataccgtagacttgaataactatcagcgaactgccaatattgtttgaaccaagagtggttattatatgttatagcctcatttagtaaaaaccacatcatttgatgaatttgcaggctaattcttgactttgacaactggttatataagactgatactatatcattatttcgatgtaacagatgatgtccatcatcctctctgatgaacccttttatttttctaagtattgcaacaacattctcatcatatacaactggcggtaaaatctcattatcattctgtttcttataatcatcaccctgttgtacagttatgtatgaaaacacacttgacatggcatcaatataaagttgatgattgtttttagaatctgcatagattgccaagtcaaaaatatccataatgttggatttgtcaatttgtcctccttctatgtgcctgagaagttctcccgcgttctcgtactttatcattaactggaatagtagaaaagtaaatcccatcagtaacaccaaaagaatggcttggatagtcacaaaacctatattccaccattctgcatgtagcagaaaaggggtagatacggcaaataacaaattcagaataagaaggacttggaacaccctatatattgtctctttcgtaaatctattcgcaagtaatgtagaatcatattgtgtatatatcctaccgatactctgcattatcaaaggatagccaactccataaagagatgctaaaatggaaagcaatccgctgaatgtataattagtaaaatcaaaaatcattttctttaatgtcttttatttgtttttctactctacggattattctatttgtctccctgatagtcttatcaatatcagagagttcagaagatataagttcaatttgttcatttttcatagagtctttgttattttgcatagagtctttgtataaaatcttttggtgttctttctgaatagatatttctgttgagtgctatatttcctgtgagcaacactcgacaaacaagcattagaatagctatgaatgaaatagcacacagcccc

SEQ ID NO: 78 - DNA (genomic), 863 bp, PORYPHYROMONAS GINGIVALIS; double-stranded, circular
  misc_feature 1...863
  hypothetical: NO
  anti-sense: UNKNOWN
ccccggaaaccaattggcatgaacattgaaaatcgacataaaaatcgacacctgaatacagcgttcatggagtatttcattttcggatacttcttcgatggctacgatcttgccatcggcaggtgctacaacggcacggtcgtcattggcaaaggggctgtgtctcttaggacaacgaaaaaagttgatcgtaagcagatagaggaaaatggcaatgatcattaccaaataggatacaatagaagccccgagaaaataaaacaggcttaagcatatccccgtgaagagggttgccatggatactaaaagtccggtgctctctttatgaaccttcatgtcgttctcatcatagttgaaatgaatcctgtgggattgcacggaggaagagtatgcccttccaccgtgttcactaatacaaaagtagcgttttttctcatcttcccgagccgtttgattatgctccgggccgtgagaatgctgaaaattcttttaagattacagcatagcgcgacagattgggaaatggaagattcgagatgcaaaattcgattccccatggttggaggtttttgctatatttgccggcccacaaagcacccaccaagaggatgtagttcttgaaggaagagtttatctgcttgatatagaacaatatgacaaatagtttacgactaaatgacaacgaatatgcacacagctttcatacatcattccctttttcatcaggccgattttaccccatccgtgtctgtcataccactgcactattcggactaagcaagaatatctctatgacgaataaagaagaataaggcttccatagtctcctcaaacatataaggcacccacggggatcctctaga

SEQ ID NO: 79 - DNA (genomic), 628 bp, PORYPHYROMONAS GINGIVALIS; double-stranded, circular
  misc_feature 1...628
  hypothetical: NO
  anti-sense: UNKNOWN
cggacagcttgcgatattggaaatgcgagtcatgatgaaaggggtgatcacagaatcctatagggtcgaattgggagaagtagaacccggtcttttcctcccgatcggactttctgtcgtcatcgaccgcaatcgtctttgggcttcgctccataatggctattctgcttcaatctcatatccaggagagcagctcgataagaccgtgctccccgtctatacgcctacggatagcagtcgctaccgcttgccggacgaattgccggtcgctcctgtttgggctgttcgcagcagctttgggagggaggatagctcgacgtattggaaaaatgtggttgtcggtcgagatcataccctgcatcagcatgtaccttggcatcgcgcattggcttggggacacaagtatcggatcggtgagccgttggcgattaggcaatgagggattggtgtgggctttggtctattataattatgcccgatcatctttggctggggcagtctctgacggctatttacgatatggcttccggaatccgttgggaagataaagcccgncttattatggtacccaacgacgcaaaagccgttggacttcttgacagcaaactggactattcttctccgcaaa

SEQ ID NO: 80 - DNA (genomic), 627 bp, PORYPHYROMONAS GINGIVALIS; double-stranded, circular
  misc_feature 1...627
  hypothetical: NO
  anti-sense: UNKNOWN
ggatccccggccaaatgagctgtcgcaggcagtacggaggagtaagtcatgatattgaagtccgagatcccggcgtcgaacaaagccatgtgatacgaaccggcatgcagttccagatcagactcgccactacccttggtaatgaagaaagtgttggggatgagattccctacaagtttgctcattttgtaattgtccttgatatgttgttagtacttacactgtttcgtctcgcaaagataggattattccgtctatatccgatgaaggtttatagcacttttccccttgcgaatctgcggagggaagtcctgtttttctttattcgacatagtgatgagccgttttgttcgatccggctttaggtgagaggggttggatatgtattgaaagcactgtcctccccatggaagaatgtcatccgcatttcattaaaaatacgtgccaaaaaaagttttcaacaacgaagacgagtttggaatgattctaaataagcgcttaaaaagaaccggattttgaggtgaaaaagaagagaaaacaggctccttgtgatctgaatctgcttttccggagtttggatcacgatttatatataaatcatttttgattgtatataaaacgatttcg

SEQ ID NO: 81 - DNA (genomic), 3087 bp, PORYPHYROMONAS GINGIVALIS; double-stranded, circular
  misc_feature 1...3087
  hypothetical: NO
  anti-sense: UNKNOWN
ctttatattcggagaaaagggaaggaaaaagcaacatcccgccactgagccagcggacgggatgtgtattggaatggtgtatggttagtcttcgttttcgtctgcaatagttatgcagcagttgtcaaggcttcggatgatcgcgagcgactccactcttatacctctttcctgtagagcctctctcccgttctgaaaggctttctctatgataaagcccataccgacgatcttagcacttgcctgttcggccaagtcgatgattccttgggcagcattgccataagcgaggaagtcgtcgataaacaaaatacgatcgtcatccgtcagaaagtcgtggctgatacaaacggtatagtctcggcttttggtaaaggaatgcactgtcgtagtcagcatattatccatcgtcttgggctgttttttcttgacgaagacaacgggcagattcatgatgtaacccaccatgatggcgggggctatgccactggcttcgatcgtgacgatcttattgactccgctgtcggcaaagagacgagcaaattcttcggccacatggtacatcagcttcgaatccatctggtgattgatgaagctatcgactttcaatataccgccgggatagcacttgccatcttgcaagatcctctgtttgagcaattccataagacaaagattgggttttctacttgtccgccggttctatttgccacggataagcatattagaaattatggcagcaagaccgccggtcgtaattcccgaagagaagatacctctcaggtcaagagatatgttgcgcaagatgtccggcatcaactcgacacccaagcccagtgacagactgatggccaaaatcatcgtagccctccggtctatatcctgagctgcaatgatgcgtataccggctgcggctacagttccgaacatcagcagcgtagctcctcctaatacgggatcgggcatcagagaaaagatgaggccgatacccgggaacaagccaagcacaatgagcatagccgcaatatagtagcccactcgacgactggccacacccgtgagctggatcaacccgttgttttgggcgaagatagaattggggaacgaattgaacacgccggcgaggagcgaattgaagccatcggccaatactccgcccgatacacgcttgatgtatttatcaccctccaccggttcgcccgaaatcatcgaattggccgtaatatcccccgttgcttcgatggctgtaataagatagatcaaccctatggcgataaaggaagacagattcaggctaaggccgtatttgaatggaacagggatattcagcagtgcgatcttcgtcgtctccataccggagagatccactcgaccgaggatgtaagccaaaacataaccgacgagcagaccgagtacgatggagctcatacgaatgtatttgtttttgctcttattgaagaagaggacgcttaccaagacgagagcagcaatgctgagattctgccagttgccgaaagtcccgtcgctcatcgccgcattgcctcctccgcatgagataatccccactttgatcagactcagaccgatcagcaagaccacgattcccgaaacgagaggcgtaatgatctgcttgagataacggaaggtacggctgacgatcatctctaccggagctgccgctatcgtacaaccgaatataagtggcaggccgccggccaggcccgcgctgataatcgggccgataaaagaaaaacttgtgccctgcacacatagcagcccggcacccaaaggccctactcttctacattggataaaggtggatacccccgaagcgaaaagagccatggagacgaggaaagaagtagtctccagatccagatcgagtgctcctgcaatgataagtgggggcgtaatgatagccacaaagatggcaaggaggtgttggaaagcagcaaagacagcatctttgaaagaaggcttgtcttcgattttgtagatcagatctacctgtggggtagcttcattcggtgcgatggccataataaagtcagtgttagtcggataatccttattcctcgttgggagcaagaaaggcacaaaaataataatgaaaatgcacctgactacgctattgcaggaataattttccacggtagcacagagctacatcattgggggggtaccccaaaaagacaacaaacttaaaggccgaagagatagttgagcttgacgccgagagtcaggttcgaggatctgccgtgagggtcttgctgccggttgttgaggagatcatggaagccatagtatagccgtccctccaattcgaaggctcccagtctgccggcatcgaatccgaatccgggacctccgccaacccccattcgaagcgtccgtgcagaccttgggcatagcgtcgctgctgcagttcggtgaagtccgagccttgcttgacggttttctctgcaatgatgaatccgaaccgaggccccaaattgagaaaagcatagagacctctttgccggattttaatgtgtgtgagcagaggtatcgtcacacaatcgaatgtgcgacgataggcattgtccggcttttcgtcaaatttctcctcccatcctaagcgaatgtagctcgcttcggcttgaaggcccactttcaaggtgcccgtactctcctcatttacccgtacaatgagaccgctcgaaggagccaacaagagcttttggtccacagcgggattgaagagcaccttattggccgaaacgcctccggctaccccgacctgtacacgtagcgactgcttggacgtttgggctgtggccgagtttatcagacataggaaaacaaaaaggctgatacctattctacgaatcatgttcctctttggatgagccggtatggacagggaaagtatggagcagtgcatagcaggagttatcgagatacgggcacacgatccacccctccgtcggagcgtagcgtgacgaggaagagattcagattgacaaaaccactatcgccccttatctcgcggaattggaagtccgtctgcaaccccgtagaaggaagcatggagagttgttcctgaga

SEQ ID NO: 82 - DNA (genomic), 560 bp, PORYPHYROMONAS GINGIVALIS; double-stranded, circular
  misc_feature 1...560
  hypothetical: NO
  anti-sense: UNKNOWN
ctgggcaaaacatgacgaaacgatgagctaccgtgccgtaccaggtgtggtgtacaccaatcccgaggtcgccggtgtgggagagacggaagaatcgcttcgcaaagcaggacgtgcctacactgttcgtcgccttcctatggccttctccggtcgatttgtagcagaaaacgaacaaggcaatggagagtgcaaactactacttgatgaagagaaccgcttgatcggagcacacctcattggcaatccggccggcgaactcatcgtaaccgctgccatggccatcgagaccggcatgacggatcgacaaatcgaacgaatcatattccctcatccgactgtaggcgaaatcctaaaagaaactctcgccggaggttgatactctttctgcccttttcttaggaaatcaaatctaaaaagtccgtgcagtcaacaaaaactgcacggactttttcctctcttaatatctttttctcagagtattcggagtaccttcgaaagacagcacccgaaaaacgagacctttggaaaataaggagatggaggaaagagacttaaaa

SEQ ID NO: 83 - DNA (genomic), 884 bp, PORYPHYROMONAS GINGIVALIS; double-stranded, circular
  misc_feature 1...884
  hypothetical: NO
  anti-sense: UNKNOWN
gtaaaaacacagtatgacgaagcctgaaccacagacatcaatatcttcaaaataagaaatgaaaaaagacagcgtaattttcgatctgatcgaaaaagaacatcagcgccagctcaaaggcatcgagctgatcgcatcggaaaactttgtaagcgaacaagttatgcangctatgggtagctgtatgaccaataagtatgccgaaagttatcccggcaaacgctattacggtggttgtgaagtggtagaccaaagcgagcaaatcgccatcgaccgtatcaaacaactctacggagccgaatgggccaacgtacagcctcactccggagcacaggccaatatggccgttcttctggcttgcctcgaagcaggcgatacgttcatgggactgaacctcgaacacggcggccacctatcgcacggctcactcgtcaatagctcgggtatcctctaccgtcccatcggctacaatctgagcgaagagacgggaatggtggattacgaccacatggagaaaatggccatcgagcacaaacccaagctgatcatcggcggtggttcggcctattctcgtgagtgggactacaagcgtatgcgtgagatcgctgacaaggtgggtgccttgttgatgatcgatatggcacaccctgccggtctgatcgctgccggtctgctggagaaccccgtgaagtatgctcatatcgttacttctacgactcacaagacactgcgtggcccccgtggcggtatcatccttatgggcaaggacttcgacaatccttggggcaagaaaaccccgaagggcgagatcaagaagatgagcgcactccttgactctgccgtattcccggtgtacaggtggtccgttcgacacgttatagctg

SEQ ID NO: 84 - DNA (genomic), 313 bp, PORYPHYROMONAS GINGIVALIS; double-stranded, circular
  misc_feature 1...313
  hypothetical: NO
  anti-sense: UNKNOWN
ggcatatccatggtgatgaacaaatatccccacgtacgtgccgccctttgctggactgaggagatcgctcgtttggctcgtcagcacaatgatgccaacgtcctctcgctgcctgcacgcttcatctcggacgaacaggccaaagctatcttgaaaatctatttggagacgccttttgaagggggacgccacaaggcccgaatagacaaaattcccatccggaagtagtacttaacccaacaaaaaaccaagaaataaagcaatgaatatcgataattcttccacaacgattcagggaaagaccatcgtcgtc

SEQ ID NO: 85 - DNA (genomic), 632 bp, PORYPHYROMONAS GINGIVALIS; double-stranded, circular
  misc_feature 1...632
  hypothetical: NO
  anti-sense: UNKNOWN
ctgaaatggactatggcgtttgggaaggacttcaaagggaggaggtaaaggtgcaattccctgaattatatcggtaaatatgaagaagacccctttcataattatccgaaaaggggagagaatcctttcgatgtccaagaacgagtcagaagattttgggagagagagattctttcactaccaagcagcgtcaatcaagttgttatagtgacacataaaacaacaggtagaatattattgaataatgttatagagggaaaggaatcctcttttagggggagacagatggataatgcctcagttgcaaagatctctgtaaaactaggaattgtagaagtcgagtatgagaataatcgagtatttctctcttaataactgatattttaatggatattcaaaagatagcgaagttcttcgagcagttgcaaaatcaagattttgctcaatgggaggattgtttcggtaaatatgacgttgaattttctgatgatacagctgagactttttctcagtcatgtgatcatgttgtgttgttcaataacagactcagcaaagtcatgttgctcaaaacatcagattccatactgtcaattggtggttttcaggctcataatagggggaagattgaagcc

SEQ ID NO: 86 - DNA (genomic), 566 bp, PORYPHYROMONAS GINGIVALIS; double-stranded, circular
  misc_feature 1...566
  hypothetical: NO
  anti-sense: UNKNOWN
cgggcagaatgttcatgacggccagcatgatggagagaagtgccgtcatagcccagaattgaggccagttccaagaggccgggaaaaggctgcccaatgtcccgaagccacctatctgtcctgccccttctttggtgaagacgtacttcatgtcgcttacgtagctgcgcatggtgcccataccttgtgctattccggccggtatggcttcgaatagcgaatatcggatatgatcgatggtatagatggcatccaacggtcggaggctcactccgataagtccgccggtatctaccggcagcgttatagtcagctcttcgcctgctcgggctatggacagggctatggtatcgcctgcatggctgcgaatggctccgatcacatcgcttgcatcaggcatcaacttgccatttacggcagtgatactgtcgcccgctttcagctgacaggcataagccgtcccttggggcatgacgctatcgatgacgaacggcacctgtatggacataaagccgctgttggctttgagcacacgcttcatcatatcgtgcggaacatgtacgatc

SEQ ID NO: 87 - DNA (genomic), 3101 bp, PORYPHYROMONAS GINGIVALIS; double-stranded, circular
  misc_feature 1...3101
  hypothetical: NO
  anti-sense: UNKNOWN
gacgtgtaacgttcgccgatcgagccgtcattttacttccaaaacgggctatgaggctttcataaatatcagccggtgtcttggcatagagaaagacggtatatctgttctcagtctcgtaatgattgccctcggtcagggctgtctgagtgagcagattgtcatcctccgtttgaagaatgtagaggtaattgaagtatccctgtttcatcatgagggtacgagtgtacatctgctccgaagcatcatagaaaagctcgcgttcgctcatcgggagaaaatcgaaagcctctccggacaaaaggaccggccccggcaacttttcactctcgaaagagaagataacctcataatagtctccttcggtagcactattagcaccatcggtagtacgaatgatacgtctaccgaaattgttttgttcgaactgatagggtaatccggctctgtttttgtcgggatacaactccatcacatagtgcccgttgcgcgagtaagatcggtacacccccataccattgtaactatcgctgagcatctctgccttcctgtaaacattggttgccggaaataaagctccggcatgctgatcatatacaatggtattacctgcaatactcgaaggtccggagagcgaacgcatctcggactcgcgcccgttttgtcccacgacaagggtaagctcctccgagggggacaggatccgtaagcccttcagatctacctcaacattgacttgctgatgacgaccgtgtatatcttcataagtaacggacgtttgcaaacccttgagggaagccaacggaactaccacacgaaaggcgatcgtaagaagcgtttcgtccggatcataaacgtcgaatacggtcatgagataattccccgagagcttgggggtgcaattcgcattgggcaaagacagttcgtaatgaacatagttgaccaaagtagctctgctaacggcaggcggatcgaattcgttctccagaaagccggaaacagcttcagccggagaaaccggactcgcctgccaatcgtgaccacagtgctgcagtctgtatcccagcgtcatactctcatcgcccataagatcaaaactaatccggagtccttccccactatttatatggtagtagggatatagcctcaactgttctgtgcctgtaggagtaacaagaagcgactgcactcgcgaatcaaaagctcgggtctggccgacagacggcaccgaccataagaaggaaagaaatagaaaaaaatgagacagacgaaaagaaaactgcttcatactttataatgctaagtcaaacaaagataaggttttccccccttgtttgggaagctcggagactcaatagcagattgatgacctcgactcccttgtcgtatttgaagcaccattccttataatagaaagatacccgtgattgtaatttccaatagtaagagcaacagagactacagaaaattccccgaagaggccggcctcttcggcagggggctatcgcatttgaaaggttgtactccgccttggtctcttccttctacaattaggatctctaacacattaattcgtgcttattccggacggagcatcatcaggctatatgtgtgttaatacttcaaatgcgattgccctgatgagaaagaactgcctgcatgcggatcggcatgcagccgtaacatacaaccgtagtactattgcgctcttacggagtcgggtcgtgtaagagaatcgatgccgctacgggcttccccggctctcttagtacgaagccgccggccatcgaaatcatacttgaagataaggccaaggccttgcgtcgtcagggactggcgcagatattgatagaggttgttatagtggttgtaggctttaatacgaatggagccggacggattgattttatattcggcatcaaattcgcccacataggtattctgtagattaggattgtcccgatagcccacattcccgttgataaggagacggttattcagcaaacgactactcaggagcagttctatatcggtgtcctgaaaagaggtgttggtcgtcttgatgctcgttcctatctgcactttgtcactaaggcttccgagcatattggtgagctgctgcgacagagtggtggtggccactgccgtccagttgtctgtaccgcttcccgaattatagacattctccggcgtataaaactttcctaagacaagaagataaacgatctgcttcgtcatcgaatcttcgctgtggatgagactgcgaacccgacgctccaattcgctgtcggagttgggtagcttgatgtcgaagctgacagcaggctgcaacatggcaccattgatctgaagcaggcaattcaccggaatggtagtccgtctgacgtcgctcacgagagattcgtccaagtcgttcagattggctgtcagattgtattcggccgttacattcagagttgcgtgcatcggattgccggcaaaattcacactactgccttctttgatgctgaaacgtttttggacaatctgccggaggttgaaattataagtgcccgacaacagttccagccctccgaatacattcagatcccccaatgtatggtaatcgatacgcaaatctccaccggctgatccgcgtaagccatcgccggtctgcggatccagtatcaaatccacctctgcatccggtgtcacgcctacattcatgaccaagtggaaatccgtctccggatctcctcccgtagcaggtagaagtagagaaggacgatccggcgaagtttcttgtctcgctcgctcacggctgcttttcggatctacgaatcgcaagaaacgatactcttccgctgtcgtaggctgcgtaaagttcagcacgatatgggttcctttttcggaaatcagattgacgtcgcatctcatccctccgggcacatcgcgcaaatatgcagcacccgacacataaacccggccatgtatattgnggttgtcccgctccggcacgttataagcaagtatattacgagcttcactgactttcagatccactttgatgtcatcgaaagcgcgatgcgagatatgtgcattgagtcggcccgtatgcccgt

SEQ ID NO: 88 - DNA (genomic), 780 bp, PORYPHYROMONAS GINGIVALIS; double-stranded, circular
  misc_feature 1...780
  hypothetical: NO
  anti-sense: UNKNOWN
gcgctatagccgtctttctccaaagtctttacttgcgtaaccacacaaggaccaacttcgataacagtgcatggcagattcttgccctcggcactgaatacggatgtcattccgattttctttcctaataaacctggcatttcagtttttattaaacgtttctcaaactttgatttccacttccacaccgctggggagttccaatttcatcagagcatccacagtcttggcagtagagttgtaaatatcaatcaatctcttgtatgaagagagttcgaactgctcacggctcttcttgtttacgaacgtagagcggttcactgtgaaaatccgcttatgcgtgggcagaggtataggaccgctaaccatcgcaccggctgctttcaccgtctttacgatcttctcggcagacttgtccaccagcatataatcgtaagacttcagcttaattctaatcttttggctcatatctatgttgttcttttatttgatcaaatcaacgcgaccctgagcttcggtaagcacctgcttagcgatggtagagggcacttctgaatagtgagagaaggtcatcgtactcgtagcacgaccgctcgttatcgtacggagagccgtcacatagccgaacatctcagccagaggcaccttagcctttacgatacgtgctccggtacggctgctttccataccttccacctgaccgcgacgcttgttcaagtcgccgatcacatcacccatactctcttcgggagtcaccacttccagtttcataataggctc

SEQ ID NO: 89 - DNA (genomic), 540 bp, PORYPHYROMONAS GINGIVALIS; double-stranded, circular
  misc_feature 1...540
  hypothetical: NO
  anti-sense: UNKNOWN
ggcgaaagaaacaccgcaggacgataaggaagctttcctcttcaacgtatcggttccgcgcgtactctctgtcttgggaactcgcaaccccagtggttatgtaccgggtatcaacaacatcctcgaaggcggctatgtaaaggccgatggcactaccgctattccggtggatagtatgatgcagcgcggacgcagagcgatcatggctcttgaccgactacagcaaggccaaacaagccggcgacatggaagctgccctacagcacaaatccgttatagacgagaatttcccctatttcggctatagctatatccagcacaagaacgacatagttccccccgttgggctgacctactacagcttccgtatcatggtgggactcggtatgctgttcatcctgttattcctcatggcatggctcctgagcttcaaaccggaaaaattcagcaaaatgcgatggttccacatgatcgctatcgtatgtatgcctcttgcatgggtagccagtcagagtggctggatcgtacccgaaagtggac

SEQ ID NO: 90 - DNA (genomic), 875 bp, PORYPHYROMONAS GINGIVALIS; double-stranded, circular
  misc_feature 1...875
  hypothetical: NO
  anti-sense: UNKNOWN
gacttggagtccgggcgaaagagcgaagaggaattccgaaccgagctatcccgatacataggaaaagaattgacctatcagcaggtgtacgatgctctccttggttttcttgaggagatttcggccgaaaagttcgattatatcgactcgctacgccccgattatcgactcttcctcctctccaacaccaatccttatgtcctcgatttggccatgagtccgcgttttcttccctcaggaaggacgctggatagtttctttgataaagtctatgccagttgtcagatggggaaatacaaacccaatgaagatattttcctcgaaatgatagccgacagcggtatgaagccggaggaaaccctcttcatcgacgacggaccggctaatgtggcaacagccgaacgactcggtttccacacctattgccccgacaatggggaaaactggatccctgccattactcgactccttcgcgaacagaaataaagaagggctgtaccgcgaatcgtttcgctccgtacaagcccccttttcgtatcgaaagaacgtttgcttatttcgtaggctcttgcatcgtgaagtccacgttcagcttattctgatccagtccgtaccagttgcctgtaatagcatcgatagccacgggaataagaccaccgagtacatccaataccacccacttggcttccacacggttgttgattatacgtatgatgggctgtttacccggaatacgaaattccacggtgtaggatttgtcagccttgagcgagagttgcaagggcgtttgtcccatcttgtcaccattgatgtaaacttctgctccctgtgggttggaaaccatttccacagcatgcgtctgtttgccgaaaaga

SEQ ID NO: 91 - DNA (genomic), 385 bp, PORYPHYROMONAS GINGIVALIS; double-stranded, circular
  misc_feature 1...385
  hypothetical: NO
  anti-sense: UNKNOWN
gtcagatttttttctttataaaatccctgacagatgtttacgtatttatgaatgatatggagaccgtggtagcaaagattatttttggagtaggtaaagatggtttcgtctatgtgcgggtcaattccggacagtggaagttgcattatatctatcgcgattatcaaggcagcgtgacggatattaccgatgcctccggcacggtggtacaccgcatgcgatacagcccatggggaaaattactgcatacggatggtacaccttatacccgaagcgaagagttatccaccgactatgaccggcttctcttccttggacggggttatacagggcacgagtatcttccctggtttggattggtcaatatgaatgcccgaccgtccaa

SEQ ID NO: 92 - DNA (genomic), 897 bp, PORYPHYROMONAS GINGIVALIS; double-stranded, circular
  misc_feature 1...897
  hypothetical: NO
  anti-sense: UNKNOWN
tacacancagcaccacgaagtggcgaaatttccgcatatgcagaaatatattttcgtatatactccgataaattttcgtatatacgggaaataaatttccttatatacgcaaatatatttctctatatacacaataaagagaggctcggaatattgctctggaactctataggagaatgaatccagagcaaagggctaaatctgcttgtgtaaacctaaggggaaataccgatcgacagttgtaaccccagcataggactaaccggtatgtctgtaaacatatatgaatcccgcgcaccccaactgtcaacttttttcagtacacaacagtttgcgagaatatccctacctttacacgtaaagaaaatagaaagcaaattttgatgactacgtcccttttcaacaacgatgacctgaaccaactggaatctaaaggcatcacaccggaagaagcaatgcgccaggtagaagctctcagatatggattcccgtatcccaatatcattgcacctgcttcattagagaatggaatcatgcgtttggatgaagatgacaaatccgcttatctgttggaatgggacagatatttgaatagtccgaactgcaacgttgtcaagtttgtaccggcatccggtgctgcttcgcgcatgttcaaggatttgtacaacttccttgatgccgattcaatgagccaactacggatgcagagaaggcgttctttgcacaccttactcgatttgcattctatgactcccttaacgagacatgcctgcgcaatgcttggcgcacagtgcccaaactcatagctttcaaagaatacaagaccgtggtggagaatctgctctatcccaaaggtcttaactatggcaatcttccgaaaggttgcttctctttcac

SEQ ID NO: 93 - DNA (genomic), 485 bp, PORYPHYROMONAS GINGIVALIS; double-stranded, circular
  misc_feature 1...485
  hypothetical: NO
  anti-sense: UNKNOWN
ggcgcagaaggctctgccgcatgtgtccaccggagcggatgcccttgtagggcggaaagtgctggtgacggaaaccatagatccgacgacggacaaagggcgcgtggctgtggatggagatgtttggacggctcgctctctgacaggggaggtgatagaaaagggtatgcgtgtggaaatcgtatcttacgaaagcattgtcctgaatgtagtggttcttggtaacgacaaacaataataatccaacaataaaacttatttcattatgacagcaacaggatttatccttgcggctctgatcattcttgtgatagccattattgccaatggcttgaagatcgtgcagcagtccgagaccatgatcatcgaacgacttggcaagtattatcgtacgctcagttcgggagtcaagtatcatcatcccctttatcgacaaaccccgtcccatacgcaagcgcatcgcttatacactacccttcggacag

SEQ ID NO: 94 - DNA (genomic), 2704 bp, PORYPHYROMONAS GINGIVALIS; double-stranded, circular
  misc_feature 1...2704
  hypothetical: NO
  anti-sense: UNKNOWN
tatgaccaatgctataagatactgtcttctattcataatgttgctgatatgattcaatcaatggttacatgctcagcctccacttcctccttaaggaaaagggatgccaattctccaaatttgtccggactctccgtggtgtagtaggatgttttgccacccttctcaatgcgtctgtccatttcggggtggcgactgagatagtctttcaaagaatgcgccacaagttcaccctgtgctatgagcttgatagtaggcgtaagcaaacgcttcatcttaggacgcaatagaggataatgtgtgcacgccaatataatcgtatcgatggtatcatccttggcaatgatactgtccagatgcttgcgaatgaaatagtcagcccccgggctgtcactttcgcccgtttccacgagtggtacccacatcggacacgcctcttcggtgactgatatttcggggaacaattttgcgatttcgagctggtagctatgcgaactaactgtaccttgtgtggccaaaacacctacgtgcttagtccttgtgatctcatctacggcttcaaccgtagggcggatgataccgaggacacgacgggtgggatcctccatattgggcagatcgcgttgctgaatggttcgcaaggcttttgccgatgccgtattacaagcgagaatgactagcggacaaccgagttcaaagagctttctcacagcctgtagcgtgaatttgtaaactacttcataagagcggttgccatagggagagcgggcattatcgcccaagtaaacaaagttgtactccggcatgagtttgcggatctcactcaagatggtaagtcctccataaccggagtcgaatatgccgatggatgggttcatgttgatgcttttatcggaggtaaaggtaccaataattgggccgccagtatattccgcctcattattttttatcagaaacgaccagcataacgatgcccccatagggtgtttggtgctcgaagcaagtctcaagctcatataagcccgcataaacctgagcacaaagaatagttcccccatgcgtgaagatagctatatgcccgaacggcatcgcagtcacctcttccagaaaattgcttacgcgttccagctgcatgacgaaactctcgccccccgttgcaggtgttcgtagataatccgcgtaataatcttgcaagcgaggatcgtctatatggtcatatcgctgcatctcccacaaaccgaaattaatctccatcagtcgtccgtcttgtatggcatcaggataaccgcaaaaatgagccaaacgggcacaacggctgagcggactcgtatagacagcatcgaagtccatccccgatagccggcggcgtacgacctcggcctcttcttcaaaggaagcccgtaggggtacatcggattgcccgtagcatattccggcagggacatccggagtcgtgtggcggatgagagtaatctgcatcttacaattctatgatcctattcataataagcattcctacccaaaaagacagctcacagagaagaaaagtagctccgcagcaatcgcctgtataaccgcctatcttccgcttcataagaccgcgcagcaagaggaaagccaaaatggggatcaagactgccggccaataagggagtggaaggaagagggccaagggtaaagctccggcagagaatgagacccaaaaagtcaagacacccatcggactgtatatggcttgcaccttactctcatcctcggaacgggcgtagggaagcgtattgatgagctgggaggccaccaatttgcacagaggatcgcccacacctaatgcgacaagcgtcaggatcggagggagagaagacagagaatagatccctatcatgaagtaaaagatgaaggacagaataccataagtacccgtatgcgaatctttcatgatagccaagatgcgctccttggttcgccctgcaccgaatccatcgaagaaatcacccaatccatcctcatggaaagcccctgtaaagagaacgcgagagaggagtgcaagggaaacgaccatagtgacaggaaggtcgatcagtagtcccaagtggcagattagaaccatcagtcctcccgtaagccaacccaccagactccaataatcggtggcgcgcttgaaagcagcatcagggacactcaccaaacgccacagcggtaagcgtgtgagcagcataaatgctgccaatattcgctgatatggttttgcctgcttttccttcatgaacttttagaaatacttagtcacagccgcttgagcaaaagtatgcatttcgttgatcatgctgacggccgatactatgatggggtatgagcacaccgctccggaaccttctcccaagcgaagccccagattcagaagaggtttggccttcatatactccagcaggcgtgcatgccccgattcgtcgccgcagtgaccgaatacggcatagtcgcagacttcgggatagaactgcgatgcagcaaggaggcaattggtcatgatgaatccatccacgatgatcagcatccccaactctgccgcctgaagcattcccccaacggccattagcatctccaatcctccaaaataagtgatgacgtcctcggtcgatccgttgcctttatagttttctttggcctgtttgagaatgttatacttatgtctgactccctccgaatc

SEQ ID NO: 95 - DNA (genomic), 524 bp, PORYPHYROMONAS GINGIVALIS; double-stranded, circular
  misc_feature 1...524
  hypothetical: NO
  anti-sense: UNKNOWN
ggagtagtaattcctgaaatccttgagcttttgcagaaagtcgaacaggatgctcttcagattgtccaaggagagcgcgttggcttgcagttcttccttttctttttttgtgagttctttcttcttggaggatttgtttccggaagattggctttcgaagagtttcttgccgtatgcggctccttccaaaaaggagaaatgcttcaggatcaaacttctcagccgagctttcctctccagatcgttgtcgaggtttttccattggcccttgaagaagagtatatcctcatcgttggttatatcggccttgctgtaggcgagctgcctgtcgatgtgggcgagggtaatataggcgttgtgacgtgccagattgaagaaagctgcccagaaatgtttgtcctccagcgtgtagtaggtaccgttgtacggtttctcgttttgttctgtcatattctaaaataagtggtgtggatcgataagcaggcctatcgggtttcgtcatgcgcccgaatgcctgcccgttt

SEQ ID NO: 96 - DNA (genomic), 538 bp, PORYPHYROMONAS GINGIVALIS; double-stranded, circular
  misc_feature 1...538
  hypothetical: NO
  anti-sense: UNKNOWN
gagatcgttcagattgcctgtccccaagtatttacgggtgtactggacgctgcctccttccacttgatcaacggatccgaactggtacccggatgcggagtaaggaagcactcccgcactcatagcaatggatttggaaataggaaaaagcatggcgaaatactcaatgtttcccattttcctattgtcctttttcccgttctcggcataccacgtaattccggtagatgcaccgaaatcgaagataaacgtcatcgaatccacagccgagtatgaagcaggattgacggcattgacgtatgtgccctgacgcagaccgacgccgagtcctcccatggaatgcccactaatagtcgtccgttctccgagacggccaaggccgaagcgagtgtaaggcgactcggtaaagttgttgttctgagcctgtataccgtctgctgcaaatagcaacccaatgatcagggcataccaccgaagcgacgcatacaaacccttatagtctttatacattatattctaaaattctatttangcccaa

SEQ ID NO: 97 - DNA (genomic), 484 bp, PORYPHYROMONAS GINGIVALIS; double-stranded, circular
  misc_feature 1...484
  hypothetical: NO
  anti-sense: UNKNOWN
tcgttcatcttctcagaagaaggaatatggatatgccaatatcttatatcatggttactttgctaatagataatcagttgggggcgattattcgtaagtcccagaattttgaagaactttctgatttgattagtaaacaaggattaatttctcgaaaattagcatctttcggaccatatttcataaatgctatggtaattctcaagcaaagtaaggttatcgctatatcaggcgatgttgtgcaattaattgattattcttttcctgatgagaatttgcgttctaagcgattggagagaattatcaatgataccaatgttttattggatatgtgtagtaacttatcttccaaagaaatttataacaaattgaatgtacaattatgaatctatatattgctagcataaaagttgtggttcaaggggtttaaagaaaatacagaaagattcgataacctactcgttcgaaccaaataaaattaatg

SEQ ID NO: 98 - DNA (genomic), 1927 bp, PORYPHYROMONAS GINGIVALIS; double-stranded, circular
  misc_feature 1...1927
  hypothetical: NO
  anti-sense: UNKNOWN
ggcgcatttcctccttcacggtttcatcaatatccaatgcttcgataaaacttgcaatggattcggctgtcaccgtctcattcgtacgcgtcagagccttcaacgtttcgtatggattgggatacccttctctacgaagaatagtttgtatagcctcagccaccacagcatagttgttctgcaaatcccgatcgagagcagcttcgttgagaagcagtttgccaagccctttggctatgctcgtgactgctatgagagaatgcgccaaaggagttcccacgttacgaagtacagtggaatccgtcagatctcgctgcaagcgggaaataggcaatttgcgcgacaaatgctcaaatatggcattcgcaatacccagattgccttcggcattttcatagtcgatcggattcactttatgtggcatggcagaagaaccgacctcgccggccttgatcttctgtttgaagtactccatcgaaatgtactgccagaaatcacggcagaggtcgatcagtatcacaattgatgcgacagcaggcatcaaaataaggctgccatgtttgtcgtagttggatatatgtgtagtgagttcttcccgttcaagcccgagagaagttacaaaccgacggccgaaatctgctccagtcatgatcaggataagccacatgatgcgcattgaaattgcccgtagcaccaccgaatttggctgaatgaggtacttccagcagcaagtcgatctgcttgcgcaagcgatagacgaatacttctatttcctttcctaagcgagtgggcgacgccggctgtccatgcgttttggccagcatcgggacatctttccactgaagggcataagcatgaagctgctccaccagctcctgtaaagcgggcaagtaaacctcggtcattgcctcgcgtatcatcatcgggaaagccgtattgtttacatcctgcgaggtcagaccgaaatggataaattctttggcatctcgtatccccatggcctcgaaccgctctttgaggaaatactccacagccttgacgtcatgattcgttaccgcctctatttcctttacacgtacggcatccttctcgctaaagtcttggtatatacggcgcaactcttcctctaaagatggagggcacacatctttcagcgaaggcaattcattgcaaagagcgatgaaatactccacctccacttttacacgatagcgaattagagatccttctgaaaaatagcgactaagtacttctactttgttgcgataccggccatctatcggagagatggcttgcagggcttggaaagcaatcatttgtttttattctgatataatcggtcgatgaaagcagcaaagataaaaaaagatttttctgactaaacctaatatccgaagccttttctcgctccttctttattaagcccccgaattgattctacagccttttctcaatcgcaggtcttatcccaaataatttcacctccggtcgtacgccaaacttcttttcgagccagagcaaagaaataatcgctcagacgattgatatagcgcatcacaggctcctctaccagcgcctcttcactcaagcggtatatatgacgttcggctcgccggcataccgtacggcaaacatgcgccaaagaggcagaacggctaccccccggcaagatgaaagccgtcatcttgggaatggcattgtccaaacgatctatttcctgctccacacgttctatcgtttcgggatgcactcgactctccaccatcagctctctgctctcctgatttgtggccagatagggatccgacggtgaaaagctttgtgctgtatggtacgcanaaaatcccgatcctcttccggcaagtcctaactcatcagcaaagccgataaatgagttcaattcgtctatcggtaccgnagcactcaa

SEQ ID NO: 99 - DNA (genomic), 565 bp, PORYPHYROMONAS GINGIVALIS; double-stranded, circular
  misc_feature 1...565
  hypothetical: NO
  anti-sense: UNKNOWN
ggctgctgttctgccagcacttcgtcgagtgtctgatacagcctttggtcaaagagcagcgcaaagtcctgcaaggcattcagagcgaatccgatttgcaataagcctctaaaagaaatttcgcccgtacgctcgaatctgcgataggtaggcaacttcattcctgcccgtaaagcgattccctcttgtgtcagattcatctccaaccgtcgggcctttactcgggaagcaacctgcatagctacggactgcggattgcagtctataagtgtcaaaatattatccatacatatcaaaaaaatctctttattatattatgttatcactttcgaagataataaaaccgttcaaaaaacacaatcaaatggactgaaccaccaaacgactagaatctgttttttaatttatcgtaagagattgtccagtgctttttcaagggtgacatacttgaaacgatagcccgaagagatgattttttcggccgataccctacttccttccagtagaatggaagcccgctcgccgaatacgcgacaaataacccatttgggtatggagggaaaga

SEQ ID NO: 100 - DNA (genomic), 594 bp, PORYPHYROMONAS GINGIVALIS; double-stranded, circular
  misc_feature 1...594
  hypothetical: NO
  anti-sense: UNKNOWN
cgcctttcagtttcggcaggaatgattcccagtcgtcctgcaagtcgcccaatccccatgtggaagagccgagaagcagtacatcgtatttcgctgcagcggcagcgtcggcatttgccacgtccattacattagcggagtcaacgcctaatgcagaagcaattttttgagccagatcgctcgtcgttccggtagaagaaccgtagaagattccgattgatttcatgtttttgaatagtttatattggtttgacctgcgcaaaagtagaggagatcaacgacttgtaatatcaccacaaatagctaaaaagaataggtccatacctatatgtggggggattcccatcgaaaaaaagcagcccgactaaggccgtgcggaggcgaaagcatagagacggcatacctgctcggccgtgcgccggaggttgtcccgtgcataagccggattcatcgcctctctaaggctgacgggagaaggagtaatcggaaagaggccgaggaaaccggcgcggttaagagctacagcatcctcgatactggccggccagcaataccacgggtatcttctgcttcatagcctnagccaacacaccg

SEQ ID NO: 101 - DNA (genomic), 486 bp, PORYPHYROMONAS GINGIVALIS; double-stranded, circular
  misc_feature 1...486
  hypothetical: NO
  anti-sense: UNKNOWN
gaggatactggatagtatccattgacatacttatctcctcgccattccaacaatctccaaaaaggagaagtacccccccgtacccggcataccatctttgctgatattggaatgcattacaacccattcttcgaatcggtctccgtagtatttatacttcgttctttgtttgaagtactgcaatgcttctttgagttcgccaataagccggttcaatatctccatagtatattcaagaaaatgcgatgttatagaatgtgttgcatatttattcgttgcctctgtctgaataacttctgtctcttagctgatttcgatcggaatttgaaatgcaattaagcaattcttttttttgtgtaagtttttaattttatgtgtgctgttattatggttctgatttggctattctaatacattcttctcgtgattcttctattatttgaattttagccggattgtttganaggttaagtaggggtagatgtt

SEQ ID NO: 102 - DNA (genomic), 533 bp, PORYPHYROMONAS GINGIVALIS; double-stranded, circular
  misc_feature 1...533
  hypothetical: NO
  anti-sense: UNKNOWN
ttagcttctttggcctctgcatactacggacatccatctcgccatctgactctggtcggtgtaaccggtacgaacggcaagaccaccgtagccactctactatatcgactattccgaaaaatgggatataaagccggtctggtgagtacggtttgcaactatgtggatgaccggtccgaaccgaccactcacaccacaccggatccattggcattgaatgctcttttccgtcgaatggcagatgcaggttgcgaatatgcttttatggaagttagctctcatgcagcggcacaaaagagaatcggtgctcttgacttcgacggcggaatctttacgaatcttactcgtgaccatcttgactatcacggctccgtaccggagtatttgcgagctaaaaagagttttttcgatggcctcggtgcttcagctttcgcattggtcaatgcccatgataagaacggcctcgtaatggtacaaaacacccgagcacgtgtatgtacctatgcactgagagcatggcaaactatcgagcc

SEQ ID NO: 103 - DNA (genomic), 418 bp, PORYPHYROMONAS GINGIVALIS; double-stranded, circular
  misc_feature 1...418
  hypothetical: NO
  anti-sense: UNKNOWN
gcctcagcatcggagtgcacctgctcaatctcctttgcatccctgccatggctttggtgtattactatcgccgtgctgttaaacccacaggcaggggagctttgttggcacttttggcttccttcgcccttatcggggtgatgatgttcggtgtgatacagggtatccctaaggttgccggcgtattcgatgtcttcgctgtcaacacccttggtttgagcttcaataacggtttgtatttctatttcttcctgctggctgccatattgatttggtctgtgagggagacttattccgtacagaccgacggtgataagaagggtacaaccaaatcgatgcgcatgcgctttgccgcgctgctgagtgtggtctgatgggtattccttttatcggcaatggcatccttctcgcatagcct

SEQ ID NO: 104 - DNA (genomic), 792 bp, PORYPHYROMONAS GINGIVALIS; double-stranded, circular
  misc_feature 1...792
  hypothetical: NO
  anti-sense: UNKNOWN
gtcaaggatatgcatggcaagtatcctttccccgaggccacggcaacgacggaagtactggtcacgggagagaacgcaggcaaacaaatgaagctgctggtggccagcggactcgtgggcggtctgtacgacttcatcgtgggcaccttcggctggtggacggagaacgtttccacccggctggccgaatggggagccgtactggccgagaagtacaagctggtctttaaggtcaataccggagcggccgtcctcggcctgggctatatcatcggtctgccttatgccacgatcatctgtgccggttcgtttctcgtctggttcgttatcatgccccttatcggctacttcgcccccggtatgactcaggccatcggcgacggtgtgtcgctgactatcggcctgatgagccctgaggatattttcgccgtctatgcgcgtcctctcggcatcggaggtatcgccatggcgggtatcatcgggatcctgcgctcgtccggaattatcggccgggccgtcaagctggccggtaccgaattgaccggcaagcggacgagtaccatcgatgagcctcgcacacagcgtgatctctcgatgaagttcattacgctgggcgtcatcgtcgctttggtggtgacgatgcttttcttccagttcaacgtgctattcaactggggacatacgctgatatccctgctgatcgtattcattattaccttcctttttaccactgtggctgccaatgccattgccatcgtgggcagcaaccccgtttcggggatgaccctgatg

SEQ ID NO: 105 - DNA (genomic), 652 bp, PORYPHYROMONAS GINGIVALIS; double-stranded, circular
  misc_feature 1...652
  hypothetical: NO
  anti-sense: UNKNOWN
cagcaacacccaaactggcaccggagctgatgccgagaacggacggaccggccaaaggattgcgaaagacggtctgcatctgcaagccactaacggataaacctgcgccggcaaaagcagccgtgagggcttcgggcaggcgggatttccataggatattgtagtgcacgagtgcttctcctccttcgggacgatctgaaaaaagatgtcggaagatctcgctcatcggaatagccaccgagccgaggaagagattaaccccgaagagaatgagtacagcccctcccagcgcagccaggatacctgcgacagaaattgtacgtaagtggctgacggatgtcattggagcaaataatagaaatgcggttggtggtcgggaagtagtccggggtgcaagatagcgataagatcggccagcacccaatcgggatgcatgggcatgagttcgtagaaggctgtttccctcaggttgcagtatatcacgcctttttccttgaatgccctgaaatcggcatatcggctgtcttcggctttcaaagcttcgtaaccgaactccccgggatagctgttgaggattcgccagtagcgagccgaatcggatcggctgtagaccgtctcgaagtcgagggaaacaccaccggatcgttgatcg

SEQ ID NO: 106 - DNA (genomic), 3469 bp, PORYPHYROMONAS GINGIVALIS; double-stranded, circular
  misc_feature 1...3469
  hypothetical: NO
  anti-sense: UNKNOWN
ttttcccacacgcccttgttcggcgtaatggctgtcaccagatcagatttcccttttttactttctcttcgtcgatacagcttagcggcactttgnccgtgtatcgtccgtatggttctaattgttcgacaggcaagtcgattgactctgctatctgttcgattctttgcagttcgatgtcacgtgcaatctgaatgtccgatttcattctattttatttttgaagtttgggaatcctttttttgtgatgtttttattcgctgtgtatataacaaaaaaagaagtaatcggttgtacggtcgatgaaaaagcttatctttcgaacgatttttcagaaagattcaaatcataaaaatgcactgttatggctgctaaagggaaaaaaaagaatttcgtgttggacactaatgtaatgctgcacgactatgaatgcatagagaaatttgaagaaaacgacatctatatccctatcgtttcgctcgaagaattggataagttcaaaaaaggaagcgaacaaatcaacttcaacgcacgagcttttgtccgccgtctggatgagatatccgatcaagatctgttcgcgaaaggagcttctctgggagaaggcttagggcgaatcttcgtcaagatcaatggccaataccacaccaaagtaaaagaagcgttcggcgaaaacaaggccgaccatcgtatcctctccatcgctatgacgctggctgatgagcagcctaacatcaagactatcctcgtcaccaaagacgtgaacctgcggatgaaagcccgctccctcggaatgctcgtagaggattacatcaatgacaaggtgactcgagtagaccttttcgagaatgccgagccggaatacgaaggtgttgacggcgatctgatcgatcgtatttatgcatccaaagacggcatcgatatagacgagtgggaattgggttcgaagatcgatcctaacgactgctttgtgatgaagagcgaacgcaacagtgtattggcacgttacaatcctttcaccgggaagatagttagggttgagaaaggacactatttcgggatccaaccacgcaatgcagagcagaccttcgccatgcacatccttacagatccgaatgtaaagctcattggactgacggggaaagccggtacgggcaaaacattgctggctctggcagcagctctcagtcaggaacagtcctacaaacaaatcctgcttgcacggcccatcgtctcattggccaataaggacttgggattcctgccgggcgatgagaaagccaaagtggcaccatacatgcaaccgcttttcgacaatctgaatgtgatcaaaggacagttggctcaaaatagcagcgaactccgcaggctggacgaaatgcagaaaaccgaaaagctcgttatcgaagctttggcatacatcagaggacgtagcgtgtcggaaacgatatttatcgtcgatgaagcacaaaacctgactcctcacgaaatcaaaacgattatcacccgtgcaggagaaggtagcaagctgatttttacaggcgacatcgaacagatcgactctccatacctcgatgcccagagcaacggattggcctatatgatcgaaaggatgaaggggcaaccgctcttcgcccatgtcaatctgatcaagggcgaacgaagcgagctgagcgaattggccagtgatttgctctgattctccggttccgtttttcaaggaaaacaaagaggccgacacaaacgtcagcgtaccttatccggattccggttgacgaagtctttccaattcttgactgccgatccgcccgaacgagccataggtcccgacgtctgaaagaagtggcagacggcagccgccagtccgtccgtggcatccatttcaggtaacatctgttcgtcaggtattcgtaaatagcgttggagcatgccggctacctgctctttgctcgcattgccattacctgtaatcgcttgcttgatgcgcatcggagcatattccgtaataggaatgtcgcgagccaaagccgctgccatagcgacaccctgagcccgccctaacttgagcatactctgtacattcttcccaaagaaaggtgcttcgatagccatttcatccggtaggaattcatcgatcagacctgtaatcctgtcgaatatgcgtttcagacggatatagtgattgtcgaatttctccagacgtattacccccatagccatgagtcggggagtattccccacgacgtgaagcatcccgtagcccatcagtattgtgccggggtctactcccatgataatgcgttccttcggactcattctttgcttacaattctattcttctcatcgtggtgaaaaagcagatcagacaccgagatcgtggaggattgcttacaattctattcttctcatcgtggtggcaaaacccatgaccctgttgccgaacttcccgatgagggtcgctatatgttttgcccccagaccgcaccaatattcatctatatcagtcgattggtctgcgaagaaatggagagccagcgatacgccttcttcctgtgctcccttttcgatgcggtgtaggacaggggaatgcatagatccgtcagcaatgaccgatgggatgaaagtcgaacgaagatagtcgatcaatgtctcctctacggcagcctccgttacccacgttatattgtacaaaatcattctgtgtattcctttcagagataacgcaaagttatgaaaaaccgcaatgagcacttttcccttcaaatatgtggaacgttagaagctataatgcaatcaaaataagaaattgagataatttgacttttgatttgaaaaaaagaagtaatttgcaggcagtgcagcaaatatagtggtatgcggtatctaccgtaattgtttaatcataaaaaatcatggtatgaaacatttcaattttatctcgttgttttccgctctggctttattcttttgtgtgaaaatacccttgcacaacaaaaaacagaggagtttgcacctgtgtcggatttacgtgcagaagcgtacggctctaccgttttcctccactggactccgccgtatgacaatccgatgattcctctaagcgagagttttgaatcaggtattccagctatatggaagaccattgacgcagatggcgatggctataattggatgcatttgaccaatttcacgggacagagtggtctctgtgtctcttcggcttcatacataggcggcgtcggagctttgactccggacaattatctgataacacccgaattaaaactacccacagacgcgttggtggaaataatctattgggtatgtactcaagatctcactgctccatcggagcactatgccgtttattcctcttctacaggcaataatgctgctgactttgttaatctcttatatgaagagactttgactgccaaacggatacaatcccccgagttgatccgcggaa

SEQ ID NO: 107 - DNA (genomic), 4792 bp, PORYPHYROMONAS GINGIVALIS; double-stranded, circular
  misc_feature 1...4792
  hypothetical: NO
  anti-sense: UNKNOWN
aacctattcttctatcagcggaagaaatccttcttcactcatcagccggcacaccgagcttctcagctttctctctctaacttcgggccccaatatccgatcccggcaagaatgaaagaagttcttggacgaaacccgatccgggccatacgtccgccattgtcctctaccatagcttttgtactcatcacgactacgcttttcaaatgtaccactgataacaaccgtttttccggctaaacgattggaaaccgccacggaaactgtctcagcttccaacgatacaccggccaaacgaagtcgttcgatcaactccctgttctgccgaaggctgaaaaaatgaagtacagcagcagctattctttccccgatctcgtctatctgtactaattcctcgctcgtcgcagcagccagggcatcgatagaaggatagaccgcagcaagtttcttggctacggtttctccgacaaagcgaatacctaatccgaacaaaatggcctgatacggacgggctttggaggcttcgatactgtccaaaagtttggcagcagcccgttttttgaagccgggcagagtgagtagctgctcttccgtaagggcataaaagtcagcaacgttacgaatcatattgcggctataaagcaattcgatcgtctccgggccgatattgatgtctgccgtcttgcgtccgcaatagtgttcgagccgtcctttctgctgctgtgggcagccctcggcattcgggcaataataggcagcttctccctgttcgcgtaccaatggtgtagcacagtctggacagagcactgtaaaaactataggtctgccatcgatactgcgtgcatccgtatccacacccactatcttgggaatgatctctccacccttttccacatagacaaagtctccctcgtgaaggtctttctccgcaataaaatcagcattatgcaagctggcgcgtctcacgaccgtaccggatatcagtactgggtcgagattggccacaggtgtgaccgcccccgtacgccctacttgatagcttacatgctgcagacgagtacgtactcgctcggcctgatacttataggcaatagcccaacgtgggcttttggccgtaaagccaagcaaatcctgctgagccggagcatttaccttgaggacaataccatcagtagctacgggcaatgtcagacgctcggtatcgaaacgatcgataaaggcatatacctcctccttactacagcatagtgtgacggcatcagagactttgaaaccccactgacgcgcctgcatcagtcggtcgtaatgattctctgccaaaggttcatcgctatatagatagtagaaataagcatccaagtttcgtccggctacgatatgggggtcgagctgcttaatggtaccggaagcggcattgcgcggattggcaaatagaggctccccttcggcctcccgttgggcattgatccgatcgaattccttgaaagggagcaatatctctcctcgaacttccaacatacggggataatcatcgcctcttagtcgcaaagggacagatcggatggtacggacattagccgttacatcatctcccattattccatcgcctctggtaacggcacgcaccagcataccatcttcgtagataagcgaaatggaaagtccgtcgaatttcagctctgcaacgatttcgaaaggtgcgccttgaagtccttcggacacgcgacgataaaaatctccaatctcatcgtaattatatgtattgctgagggaaagcatcggtctgtcgtggcgaacggaagcgaatccttccgttttgtcgcttccgacacgatgcgtaggcgagtcaggactatcccattcggggtattcccgttccagctcctcaagctgcttcatcatggcgtcatactcgaagtcatcgatagtcggagatgagagaacgtaatacctgtattcgtgctcacgcagaatgcggcgcagctcttctattcggacagcagggggaactatcttttccataactgataaagcaaaacatcagaataatcgccggcatgccacatccattggcggagggtggctgtatgctcgaagccggcagcttcgaacagcatccggctcggcttgttatcttccagcacataagcgatgatctgatgcaagcgtaaatagtctaaaacataatgggatatcttgcggagagactcgacggctattcccagccgacggtattcgggaataacgaataaccctacggctacacgtcgatgaaaggcatcgtactcatacagatctatcgcaccgacaggcttatcgtcatccgacaagcagatgacaagacgcatcatgcccaactccatcaaaccctcagaactcttttcgatatattctttcagccgattgcgtccgataggtaccagcatattgccactctcacgcaattcggcatcattttcccataggtagagaaagtccaaatcttccggttcaagggctcggagccgtacttgctctgaagagaaaaggtcggtcatggaatatcagaatttgactgagtcggagaaatcggtacgattgagaatagaacgaccgagggtaatctcatcggcatattcgatctcatcgcctatagcaatgcctcgagcaattacactgacccgaacgccggtaggctccaacttgcgaaagaggaaaaagttggtagtatcgccctccatcgtcgtactcaaagccaatataacctcatgaatctgctcagaagctactcgatgcaccaaagaatctatttgcaaatcgcccgggccgatcccatccatgggagatatgactccaccgagtacatgatacaagcctcgatactgtgaggtattctcgatagccataacgtcacggatattctctactacgcagagtgtactctgatcccgagtggggtctgcacagatagtacaaacatcggaatcactgatattatgacagtgcctgcaataggaaatatgttcccgaagatctacaagggctgctgcaaattgacgggtattttccacaggttggcgcaataagtacaaagccaggcgcagggctgtcttgcgccctacacccggcaatgtggcaaattggtctatcgccttctcaagcagacgcgaagaatatttctgtatcattcatccaaaatatccagctcgttgccgtcgtagtcgtaaaatgtgtagtccaggaatcccagactctcatcggggataagtttgatccccttggcatacttgagtttccatttcttcaagatagaagaaaggaaacctttcttgaggtatgctgccacgtatggatgtacgtgaagaacgaattgtttgacttggtgctccgtgaccattttggccactttttcttccaactgatccgtgaagagtatggaggattctaccttgccggtacccaaacatgtgggacaacactcttcggtatggatgaccatcgccggacgaacacgctgacgcgtaatctgcataacgccgaatttgctcaatggcaagatattgtgtcgcgctctgtcagccgacatcaatttgaccatgtgttcgtacaactgctgacggtgctgggcttcgctcatatcgatgaagtccactacgatgataccacccatatcgcgcaagcgcaattgtctggccagttcttcggctgcagccatattgacatcgacggccgttgcttcctgctcggtactgccacgcgagcggttaccgctattaacatccaccacgtgcatggcctcggtctgctcaataatcagataagcaccactcttatacgtaacagtacgtccgaagagagctttaatctgcttcgtaatggcaaaatggtcgaaaatgggtagttcgccctgataatactgaacgatttcctcccgtcccggagctatcaactcgacatagtcgctcaaactgtcccgaaaagccttgtcattgacaataatactctggtaagagggattgaagttgtccctcaagagtcccagagtacggctggcttcctcataaacaatggacggagccttggcacgcaaaagcttcttgatgttgtcgtcccaacgacgtagtaggctctgcaactctttgtccaattcggatgcccgtttaccttcagcagaagtgcgtatgataacgctaaaattcttgggcttgatgctgataatcaactgccgcaagcgtgctcgctcttcggcagaacgaatcttctgagacaccgacactttgtctgcaaagggtaccaaaaccaatgaacggccggcaaaagaaagctcggcagtcaggcgtgggcctttggtagagatcggctctttggctatctgcaccaagatctgctgtccggccttgagcacatctgcgatcttcccctctttagggaggtcgctgccgaggggcactttggacaaggatggaatcgatttgctttttgtcatcatctccatcatcttctgctgagcatcgaaagtcaagcccaaatcaagataatgaagaaatgcgtccttcttgtatcctacatccacgaaagcagcgttcagaccgggcatcaccttcttcactttaccgaggtaaatatcccccactgcaaaagaaagattgcgcggttcgcgttgaagctccacgagtttgccatcctccaggacggccatagatacctctttgggcttaacgtcaattactaattcgctgttcacttatatggtaggattgtcttgatgattataaatacaagtaagcaaatacggcctgtgggcggggatcct

SEQ ID NO: 108 - DNA (genomic), 1105 bp, PORYPHYROMONAS GINGIVALIS; double-stranded, circular
  misc_feature 1...1105
  hypothetical: NO
  anti-sense: UNKNOWN
tccccgcggaagatttggcagcctatttgggtgtaaagcatgtaatcccttgcgccaatggtacagacgcattgcaaatcagtctgatggctttgggattgaaagtcggagatgagatcattgtgcccgatttcacttatgcagcaagtgccgaagctataggtttgttaggattaacacctgttttcgctgatgtagaccctattacatttaatcttacatctaagggctgcgaaaaagttctgtccgacaagacgaaagcaatcataccagtacacctctttgggcagtcctgcgatatggagccgcttttggcctttgccaagcgaaacgatttgtttgttatcgaagacaatgctcaggcaatgggagggggatatactatctccgatggatctatccgaaaaacaggaacaatggggcatataggctgtgcttccttctttccatcgaagaatttgggttgttatggagacggtggtgctgtcacaacaaatgatgacgaattggcaaagcgagtgcgaatgatagcgaaccatggccaaaagatcaaatacaaacatgacattatcggatgcaattcccgactcgatactattcaagcggccatcctcagagtaaaattgcaatatttggaccgcttcaatgcacttcggaatgaggtcgcctcacactatacctctctgctcgaaggtattgaatggctacaaacaccgacctccttgcagcagtcttcgcatgtttatcatcaatatactcttaagctcttggatcagaacactcgcgatggactgcgagagcatctgacgaatcataagatcgcttcgatgatatactacccgataccactccacaggcaaccggcattcgtcggtattgctcattggggtgaatctttggatgtgtcccgactctttgtcgcgaactgttctctccatccccatctatccggaaatggagatagagcaaatccatgctgtggtatcagcaatcaaaacattcgaaccgtctttacaatgacaaaagaggagggaggctcgtctatgaagcaaggacgaagttccatgatggcaaacagcatgaaactgatcagcgccggtacctt

SEQ ID NO: 109 - DNA (genomic), 662 bp, PORYPHYROMONAS GINGIVALIS; double-stranded, circular
  misc_feature 1...662
  hypothetical: NO
  anti-sense: UNKNOWN
cggcaaacatcgctccggttacgaatatgcccagatcctgagtggagacaagggacatcattccatccgccatcgcaatggtaatgaatggatccggtaggacggctgcgtcgatctgtccgctgcgaagcatttccaagcgcaaagggattttattgacttcggtcttggttatctcgctttcgtccagtcctgcggtattgataattcggtcggtggtgtactcaatgaccgtattgcgcgatatacccagattctttcctttgagggtttccaagctctcacctgtataatctttggacattaccagccggaagtatccgtcgagacgcatcaccagttgcagatcgatacctcctgcttgctgcatggctgctcccgtataatcgatgaccgtaccctccacattgcccgaatggaaagccgcatcacgttcattgggcgaatagaacttgacaatctccagtttcagtctgagtgaatcgtaaatgccggttttctgtgctacaacgaaaggcagatagtccatggaaggcatggctccgagagagagggtataaggctctttttgtttgtctgcagagcttttcttgttaccacatgaagagagggtgatgctcaaaaccgccagaacaaggagggtaaaaaaagaaaaatttttc

SEQ ID NO: 110 - DNA (genomic), 2193 bp, PORYPHYROMONAS GINGIVALIS; double-stranded, circular
  misc_feature 1...2193
  hypothetical: NO
  anti-sense: UNKNOWN
cgccggtgaaagctgtgataagcgaagcagccaagccgaatggagcgatgatcttgatgtttttgagagcaaagtccttgtgtttgtcatcctttcgcagcaggtagatgccacatacgcccaaagcaaatacggatccgagagtccagcaggaagagatcgtgtgccagaacttattgatcgcagtggaagagaataccaaagcccagaaattccgtcatttcgtttgcgcatcgtatcggggttgaaggtcattcctaccggctcctgcatccatgcattggcgataagaatccatacggctgacaagctggctccgatgatggtcagccatgtggcacttaggtgaaaacctttgctcaccttgttccagccaaagaacataacggcaataaaagtagcctccatgaagaaagccaaaataccttcgatggccaatggcgctccgaagatatcgcccacaaagagactgtaattagaccagttggtaccgaactcgaattcgagaatgattcctgtggccacaccgatcgcaaagttgataccgaatagcttctgccagaactgagcataacgcttccactccggtttgccattgcgataatagatggtctccacgatagccatgatgacacccaatcccagtgtcagcggaacaaacagccagtgatacatggctgtaagagcaaactgtgcacgtgaccagcttactaaggcatctaaattcataatcatacgcttatatcttaatgttttaggggtttattccacgtttgataagttcctgctgcacatattcggatttggcagtgctgtcgctaccgacctgttgcttcagaaagttcgggaagaagaatactttcaggatggcgaacatgatgaatagtttgatgaggataatagcccatagcgtctttcccaatttcatattcctgaagccatctatataaaagcgagctatacgcatgaacaagttctcgcgctttgctttgattgttgtcatagttttttcgattcaaaaatgaaaaaccgtgcaggtctcgatttttttgctgtggtgattcagctttcttacaaatataggatgggaattgtttttggggacgcgtttcctctctaaaatatcacattcggctcaatggagtcgttgttttgtttgtttttgaaagatcatcaagtaccaaatcaataccagcaatgtccctcgcgagaggtcatgaaaagctccacatgcgcaccggatcgaatctgattccatgtgatatatgacctgtgatagggtttgccatccacttttacggactcgatataccggttcttctcacttagattgtgagccgtcagtcgaaagatacgaccattgggctgagggatagtcacatgttcgaacaggggtgatcccagttcgtaatggccgcttattggatccaccggatagaaccccagggctgagaatacgtaccaagccgaaagttggccgcagtcttcgtttccgcataggccgtcaggggtatttttgtatagttctgtcaggatgcggcgtattatccccgctcctttccatggctgcgataccttgttgtacaagtaagccacgtgatggctcggctcattgccgtgggcatattgtccgatcattcccgtactgaaaatcggcaatgctatatgagagggagtaggagtgccgaaaaagaggccaagacggcgagccatcgaatctgcaccgcccatcagttccatgagaccttctgtatcatgctggactccgaagagatattgccatgcattactctctgtgatgtcctcagtgtattcgaaaggatcgaaaggaagtttccattcccccgatgctaatttgggtctgaagaaaccgcttgccggatcatatacctcttggtatgccttggcgtggtgcgcatatgccatcgaccgcttggctgccgctgcgttttcccttgcaaagagtgcgatgcaggcattgtcgtaggcgtattccatcgtcttgctcaagctccagttcgtacagtcggccggcacatagcccaaatgacgataattgtccgtatcggttctgccggttttttccatggtcgaaaccaacaggcgcatgatgcgctgcggattctctttgtaattgcctttccgataggcttctacgatgaccggtatggaatggtagccgatcatcatacc

SEQ ID NO: 111 - DNA (genomic), 519 bp, PORYPHYROMONAS GINGIVALIS; double-stranded, circular
  misc_feature 1...519
  hypothetical: NO
  anti-sense: UNKNOWN
cgccgcttggatctcttcatggtcagctctctggacaagggcggattggattcgggtggtattttctctattgctttcgatatggtagccgtggtggaaataccctccagatccctgctcagcgtctcttctcccttgatggccgacgccatgaaacggaacgatctggtcaaagccgacgaactcttcaagcgcgtctcgctgcatcagcttctttccggtggccttatcttcttgcttatttgggtcaaatatcgacagcatcttctccatcctcccgaacggtcacctctatgccgccggcaaatatgtcgttttctatttgggaatcgctaagatgatcgaaatcacgctgaactacggcaatccgatcgtgagctgttccaagtattatcactggaatctttactatacttttcctcgtcacccattctggcccgtgctcaccaatctggtggctgatcctggttttgggaatcaacggaccggccatggcacgctcttgaccacgctgcttga

SEQ ID NO: 112 - DNA (genomic), 518 bp, PORYPHYROMONAS GINGIVALIS; double-stranded, circular
  misc_feature 1...518
  hypothetical: NO
  anti-sense: UNKNOWN
cgctttctcccgtccgcgtgccaatggtgtgatcgctatcgacctgcgagacaacgatggcttggtaagtgtccgattgaccaatggtaaatgcgacatggttattgccaattgcggtggacgtgccattcgtttccatgaatccgtggttcgtccttcgggtcgtacagccatgggagtaaagggaatgacgctcgacgatgatggtcaggacgaagtagtaggaatgatctctatcaagcatccggaagaagagaccattctggtagtaagtgaaaagggatacggcaagcgttctaatatcggacgactatcggtattaccaatcgctggtggtaaaggggtgaagacactgaatatcaccgagaagaccggaaagctggtcgatattcgagccgttaccgatgccaacgaccttatgatcatcaataagagcggtgtcgccatccgggtaaaagtggctgatctgagcattatcggtcgagctacacaaggtgttaagctcattgatttgtcca

SEQ ID NO: 113 - DNA (genomic), 1044 bp, PORYPHYROMONAS GINGIVALIS; double-stranded, circular
  misc_feature 1...1044
  hypothetical: NO
  anti-sense: UNKNOWN
ctcaccaatttttatttcacctatattatagtggtcgtcgatgttaccccaagcaaaaatcgtatataagccgtctttctccaaagggatcagccattcttttgcagctgacaactggacatcctcaaacacattggcactgcgaaggataccatccttatcgaaagcataaacgttcaatcgggcaacttccgcaggataagaaggattttcggcacactcagtctgagaatagaagttgacatatactcctcgaggacaatcatcgtaattgtcataaatcatcttatcgcacgaagccaagccaccccacagggccattattgccggcaaagaaataataagtctgcgaatatccatatgcttccgtttgttcattgttttaaaaaatatagagggtgggagaacggtgggaaccgaaatcccaccctcaaaaagaaaattttacaatagctaattagagatcaacctcataggaatgaactttccaaggcaaaactgtaacctcaaccgacatgaacgtatcctgatcaggtaaggggttctccggatctgtaggaacaggagtacccggctcatccggattcgggtcagggttattcggattttccggattgttaggatccggatccggcaccaaaggattccagttgaagcccaacttcttgatgctcttgatgtggatatggtagatattgttgcgcacaacgggagaattccaccatgaatcgggagaagtagtactgggattcaaccaagcatagtacagtactttgcctttcacatatttgtgtgccttcataccagctacaccacctaccttggggtctgtaacggatttcatagacacatagaactggccattctcaccaacgaagaaatcttcacctgctacatattcaggaactgcagtattatctgaataagttttacctctatcgataaaggcttctttcttgggagtaaacttcgcacgaaccaatacataggcagtattacctctcttatagtctgacgaagcagcattagcacctgacttatggg

SEQ ID NO: 114 - DNA (genomic), 4474 bp, PORYPHYROMONAS GINGIVALIS; double-stranded, circular
  misc_feature 1...4474
  hypothetical: NO
  anti-sense: UNKNOWN
tgatagctttcggcgatgtgtccgtattcgatgcgatggtgcaggcttctttcagccagtcgaagaatgcctttgagatagcccttgcactgaccagtgtactcgctctgtggctcggtctgatgaaaatagcagaacgaagtggccttataagcaagctggcacagatcagttcacctgttctaagccgattgttcccttctgtacctaaggaccatcccgcactgggcaatatcttcatgaatatatcggccaacctgttaggccttgacaatgctgctacccccctcggtatccgttcgatggagagtttgcaaacgatcaatcagcaaaaagataaagccagcgatgccatgattatgttcttggccatcaatgccagtggacttacgctgattccctcttccatcatggcctatcgcctacaggtcggggcggcaaatcctaccgacatctttgtcccggttctgattgccacgtttgcttccacattggtcgccatccttgcagtagggatcaagcagcgtatcgatttcttccaaaaacctcttcttctttttcttctttcctctcttctctttatcggaggggtaatctatgcaggacggactctgcctccggaaacatttagttgtatcagcactgcatttgcatccattcttctgtttggaataatgtgcggattcgtcattagtggactgcgtgcacgcatcaatgtgtatgatgcctttatcgaaggggcaaaagatggtttcggtacggctgtgaccatcattccctatctgctggccatgctggtcggtatcggtatattcagagcttccggtgccatggatctgatcactgaaggcttgcgcggactggtcggcttttggggaggagatatgaagtttgtggaaggaatcccgaccatgctaatgaaaccacttagcggaagtggagccagagggctcatggtcgatgccatgcagacgtacggagccgacagctttgtcggccgtctatgcagtattgtacagggctccagcgataccacgttctacgtcgtagccctctactatggagccgtcaaaatacgcaatacacgttatacggtgagctattcccttttggccgatttggccggagcgctgacagccattgctgtcacttatattttctttggttgagggtacggtgaccgagcaaaacgataattaagacaatggcaaaaatcaatttctatgctgaaggcgtcagccttcctcggatcagaagacggatcgtcggtaagtggatagccgaagtatgcagccgatatgggaaagcggtgggagaaatctcctatcttttctgtgatgacgaatatatcctgaaagccaatcaggaatttctcgatcatgactactacaccgacatcatcaccttcgattcctgcgaagcggatacggtgaatggcgacctgcttatcagtctcgataccgtacgctcgaatgcccgtgctcttgatcttcgatacgaagacgaactgcatcgtgtcattatccacggcatactgcatctttgcggattgaaagacaagagcaaaaaggatgaagcccaaatgcgtgcagccgaagagaaagcccttgtcatgctgcgagaaaccatcggatcggagctttccctattgcatacatgatcacatttctccctctatgagacctaagcagtggatcaagaatctgatcgtattcctacccctgtttttcggacacaggattggtgatacggaagccttgctaaggctgaccatactcctgatagcattttgttcggcatcgagtgcagtctatctcttcaatgatatttgcgatagagcgatcgaccgcctgcatcccgtcaaatcgagacgccctattgccagcggagcatggagtctctccaaagcttatatactgatagctctgcttgtggttttggcttgcgcagtgatattgtcactccttgatttcccttttgccgtctatgccctgatctctatagtgctttatcttctgctgaatcttttctattcactgaaaggcaaacacattcccatcgtggatgctttcctcgtagctttcggctttctgatcagattgtatgcggccggagcagtgagcggagtacccatttcccattggttggctttgatgacgctcttcctatccttgctgctcgccttcggcaagaggaaagaagacctgcgtctgctgcaggagacggctctttcatcgcgtcctgtcgtcaaacattatacggatggattcctcaatgtcctactggccattctctcggctacgatcattatactctataccctctatgccacagacggcgaagtcatatcgaggaatggcccgtatctgtacgtatctgtctttcccgttgccaccggacttttccattatctgagacacgtgatagtgaaaggctgtcattgcaatccgaccgatatgctctatcaggaccacgggctccagctttcggtagttgtgtggatcattctttattcgataagcccttatgtcgcataggcccatagccatattcgatttcgacggtacgctgacccgatgcgattctttgcttccctttctgcggcaagcccagccggttattctcttttggctcagactgcctttctatctggccatgtggatgtgctacaaacttcggctggctccggccgaccggacgaaagcagccatcctttccacagtcttgaaaggaaaaagggaggtggaatgccgggcaatgggacagcgattcgtgcctgctatcgaaagcattcttcgtcccgaagcccttcgctgtttggaatggcatcgcagcgaaggacatcggctggtgctactgacagcctcgcttctgccttgtgtggagccatgggctgaaaagacggggtttcataccgtcattgctacccttccggagataaaatccggcattctgacgggtcggttcgaaggcaataactgcaagggaaaagagaaaatccacaggttggatcgagccttgccgcattggcgagattcgatctcctatggctatggcgatagcccctccgaccgccccttgcttagcctctgcacacattcctactatagaagattccctgctctatagcctgccgccgcgtccgtatcgtttggagattgtcgattcatcggtgtcccgatgggtacccattttcctacccgaccataaaccgccatcagagcagaaaaaagctctcttctggatttccacataaacgactgcaatgcaacggtttgtgatttttcagttttacacataaattttcccggcctggaaaaaatattttccaggtcgggaaaacatcttttccacgggtggaaaatatttcttttcggccaaaaaaagatttctctctcataaacagaatattttcctcaataacagaaccatatctccacctaaaacgaagcactatggcacataatctcaagtgtatggtctgtagcccttgcgcaccatggtatgagatgaacgggccattgggtttgagccgttatttacgacctttagcatcctcttttctcgcctgattactcaacagtctcttggcgtagtgccaataattcaaaaagggctgtgccgaatggattcctcggcacagcccttattagagaattgcagtgtgaattacttcactataaccttttctgtatacgtcttgccttcagtagcgatgcgaacggcatacacgccgttttgtgcttcgaataccatgcggtttttagcagtagctacacgacggccgttcatatcgaagatcgtcagcccggcagcaggactttctacagttatcgtcttacctgatacagctacagtataaggcttatcattggctacgtcggcaatagatgtaccttccactttcacatcctttatcacagtaaccttattgtatcctactacggtgagcgtcaagttcgtttcatcagcgatactctcatttaatttgatgatagccttaccgtctttcacgatagcagtgccgaccatatcaccatcgtcagagagcgtagcaatagcaccgttatagtcgcaagctacttcgaatgtctgtgcagaggcagagatatttgccggagccgtaacctgcattttggtcgggacaagtgtacgaacgagcagcgaggggtcgccgaatacagtccatgtgtcgagcatcttctcaccatcctttttatacttttccaccatagcaaacataccgttcatggtgacacctccgaaagtacgcttgatgttgttcgggtgtttttcgcacagaatttcgttcatctcatcctgcccgcgcataggagaagcccaagactggttgatcgtagacgctatgatagcaacagtacctgtcggtttaccatctttttgtgcacgcatcagggcttctgcgaaacatggtacgttgtacaggaaatcgccattcacacaagctacgtcg

SEQ ID NO: 115 - DNA (genomic), 3678 bp, PORYPHYROMONAS GINGIVALIS; double-stranded, circular
  misc_feature 1...3678
  hypothetical: NO
  anti-sense: UNKNOWN
ttccctcacggtactggttcactacgggtctctcgggagtatttagccttacgggatgggccccgccaattcacacaggatgtctcgtgtcccgcgctactcaggtgctccgtcgtctattgttcgatatgtcggatacgcagctttcatgctcttcggccatactttccagtaggttctcctatatctatcattaaacttttgtcgaagtcctattaccccgactttgccgaaacaaagccggtttgggctaatccccgttcgctcgccactactgagggaatcacttttgttttcttctcctacgggtaatgagatgtttcagttccccgcgttcgctcatgaaatcaattcatgtgtcaggccttggcctgacgggttgccccattcggatatctgcggatcaattcgtatgtgccgattcccgcagcttttcgcagcttatcacgtccttcttcgcctccgagagcctaggcatccaccgtctgcccttacttacttttgttcgcccggcaatcaattgccgccggcggtatacttaagcttgttgtgctctacttaaattctttatttgattttcttccaatatgtcaatgatcgcctgttttctttcgtggagaatatcggattcgaaccgatgaccccctgcttgcaaagcaggtgctctagccagctgagctaatcccccgtagtcccaggcagagttgaactgccgacctctacattatcagtgtagcgctctaaccaactgagctataggactgcttctctcttattcgaactcttccgtctgcctgtggcagctccttgggctgcatgaccgttgccccttatctctctttatttttttctttttgccctttttgcctcgcttcaaaaaaagaagcaaagttcgaagcagggaaagctcgaaagataaacgaaccaaggcctcgggggagggaaagactccttatcttcctgtatctctccatcttcgattcaagagagagagaacaccctcccggacatcccgcttgattgcatcggaatatccgcaggttatattcgttttattcatacgtcgaacaaatatggcttttcgccgtgcagtaaagtttttcggataaaaaaaaagccgagagccgaaaccgaaggcgatatatggtcttttcttcttcccccgatcggataaatctccgacaccggttccgttgcaaaaaaccctaccttcaaccaattctccttaatttttcgggcaaccgtttatgtcaatcggtccgaactccagaaaggaggtgttccagccgcaccttccggtacggctaccttgttacgacttagccccagtcaccggtattaccctagtgcgccccttgcggttacgcccttcaggtacccccgactcccatggcttgacgggcggtgtgtacaaggcccgggaacgtattcaccgcgccatggctgatgcgcgattactagcgaatccagcttcacggagtcgagttgcagactccgatccgaactggggaagggtttagagattcgcatccggtcgcccggtagctgccctttgtccctcccattgtaacacgtgtgtcgccccggatgtaagggccgtgctgatttgacgtcatccacaccttcctcacgccttacgacggcagtctcggtagagtcctcagcgaaaactgttagtaactaccgatgtgggttgcgctcgttatggcacttaagccgacacctcacggcacgagctgacgacaaccatgcagcacctacatagaagccccgaagggaagacggttttcaccatccgtcatctacatttcaatcccgggtaaggttcctcgcgtatcatcgaattaaaccacatgttcctccgcttgtgcgggcccccgtcaattcctttgagtttcaccgttgccggcgtactccccaggtggattacttaacgctttcgctgtggaagcttgacggtatatcgcaaactcctagtaatcatcgtttactgcgtggactaccagggtatctaatcctgtttgatacccacgccttcgtgcttcagtgtcagtcgcagtatggcaagctgccttcgcaatcggagttcctcgtgatatctatgcatttcaccgctacaccacgaattccgcctgccgccactgaactcaagcccggcagtttcaacggcaggctgaacgttgagcgctcaggtttcaccgctgacttaccgaacaacctacgcaccctttaaacccaataaatccggataacgctcgcatcctccgtattaccgcggctgctggcacggagttagccgatgcttattcttacggtacattcaatgcaatactcgtatcgcccgttattcccgtataaaagaagtttacaatccttaggactgtcttccttcacgcgacttggctggttcaggctctcgcccattgaccaatattcctcactgctgcctcccgtaggagtctggtccgtgtctcagtaccagtgtgggggataaacctctcagttcccctacccatcgtcgccttggtgagccgttacctcaccaacaagctaatgggacgcatgcctatcttacagctataaatatttccttgtaatatcatgcaataatacaagtgtatgcggttttagtccgtctttcaacgggttatccccctctgtaaggcaagttgcatacgcgttacgcacccgtgcgccggtcgccatcaaccttagcaagctaagatcatgctgcccctcgacttgcatgtgttaagcctatcgctagcgttcatcctgagccaggatcaaactctccactgtcatatttgtgtttgtttgcttctgtttttctcgctcagacgccgattattaccctttggataattcgatttatcaggtagtacacctcggtttctttttctctctcggtcttttcgtttttctctttgacagagtatatgtcctcgtcgagagacggtttcgtcaataacagccggtaaatcggccctcctctctgcgagagggcagaaatcctgcaagaaatggcgaagcccttctctctccttcttgtactacacttttgttcttcgtatgaacaatgtcaatgatcgctgtctttttatcccctatcctcccacctcacggcacagagccgatcaagcagcggacagtgggtgcaaaagtaaaacctttttccgaatcggcaaaatcaatcggctcttttttcagggctgacgctcaagaaaaagctcgtcgcctgatcctccccctaaaaaaagaatcccgacgcgctcggcggaacaattcctctatcaatcgggcagcaatcgcttttgcggtcacaaaagtacgccttttttctttacagacaaatctttcaaaatcttttttcaaccggttcgacaaaaaaaacagcccccgaagaaaaggactccctcccaagaaagaagacaaaagggagcggatatataatatgttcgcgcgcgtaagaacaattaaaaagaccgcaaacgaaaagaaatgagaagatgttttttccctcgcacaaaaaagattttttgaccgaaatgttggcggttggtccggaataaagggtacaagggaaagagaagggtgtcgaaaaaaacagaggcaccaatcgcacaagccgaaactcgaaccgaaaatcgcccaaatctcaaaccaaaatcccaaaaa

SEQ ID NO: 116 - DNA (genomic), 660 bp, PORYPHYROMONAS GINGIVALIS; double-stranded, circular
  misc_feature 1...660
  hypothetical: NO
  anti-sense: UNKNOWN
tggttcggacgacctttttggttttcctcacttattccgtcgtacagctttcgttctcgctgatgcaggacggtcgggtagagatgggagacgggctgaacattctctatttcggtgtgaatctgatcttcctcatgttcagctacctgctcgtctatctgatggagcgtgctttcggctacgtttccaatatcagtttggttgagctgagcgacgtcaatacgccgctgctcagtcagctcttcggaaggtggncgccgggcacctttcagcattcgatccaagtgtccatcctcgctacggaggcagccaccaagatcggagcagatgtacagcttgtacgcaccggtgctctctatcatgatataggaaaaatgaagaacccatcttatttcacagagaatcagggagcagagaatccgcactccaaattgccttttgacgagagtgctcgcattatcattcgtcatgtgaccgatggtattgccttggcgcagaaacaccgtttgccggactccgttatcgattttatccggacgcatcacggacggggtaagaccaaatacttctataattcctattgcaatcagtatcccgaccaagaagtggatcccgagttgtcacttatcccgggcccgaatccattcaagcaaggagacg

SEQ ID NO: 117 - DNA (genomic), 244 bp, PORYPHYROMONAS GINGIVALIS; double-stranded, circular
  misc_feature 1...244
  hypothetical: NO
  anti-sense: UNKNOWN
acgctgtcgtttttatttcaattgcaccatacaggaattaaaaccgcctttatgctcgacgacgcagacgaatcggatcatttcaattgcaccatacaggaattaaaacgctttggctgcgaattcccttacgggccaatcgaagatttcaattgcaccatacaggaattaaaatgtatccattatactactcccaaaaactgacaactagtttcggggttatttggcttgttttttaggtata

SEQ ID NO: 118 - DNA (genomic), 712 bp, PORYPHYROMONAS GINGIVALIS; double-stranded, circular
  misc_feature 1...712
  hypothetical: NO
  anti-sense: UNKNOWN
ctgacatccgctcgaaccatggacacctcgtctatgataatcagatcgagacttcggatcagtttcttgtgttcgttcgtgtagcgaaacacatcgaacacccgtctgtcacgagtactcaaatcgggatcgttcggcggaatcgggcgaagaggcagtttgaaaaacgagtggagcgtctgccctccgacattcagtgccgcaaggnccggtaggcgcaagcacgacaaacttcttatgcgtcgtagcacagatatgccgaagcagtgtggacttacccgttccggccttgccggtcaggaagaggctttggtctgtgcgttcgatcaggctgagcacatagcccatctcctcattggcaaggtcgattgcggacaggccctcctctctcttttttgtcttgcgacgaggcatgcgctcaggggcgtttgtatcgggctttgactttcagcttggccggtttgctctcgttgtggaagcgatctacggccgtcacccaataagtataatcggctgaagcatgggaagtcgggaaggcgaatgctgttttcgggagtaatcacccaaatgttttcagctttgntggatcgtttcttcatgccatgacggaaggcatagaccacgaagtaggaagctttgacagggtcggaatcatcctttcagcagccnaatcaggtgaaaactgatggcaaccaagcgggatgcagccttt

SEQ ID NO: 119 - DNA (genomic), 533 bp, PORYPHYROMONAS GINGIVALIS; double-stranded, circular
  misc_feature 1...533
  hypothetical: NO
  anti-sense: UNKNOWN
ggattcgctgccggctgccgacaaagccttgctgctcatgttctattcggatgacttgtcggttcgggatatagcggaagtgaccggtatgtcggagtccaacgtgaaggtcaagctccaccgacttcgcaccaaactctataaaatgatgagaaaatgaaacagaatatagaagacaaaaagctcaaagagctgttccgacagttacccaaacagccggctcggactcaaacaacgcttcgacgtgatgcgtgccgtacgagaggaagctgctcggcgcgaacggcgtgcccatcgtctgttcggcatcgccatggtgggagtatgtgtccttgcggtggttgtcttcgtagtattagactccaagggattgtttagcggtctcgatttcgatagcttggttcaagaccgatctttccgcaatcccttcgtcggtttgggcagcgatatagccggagcacctctgatcttcctgtccgtggtcatcctcttcgggctattcctctacgaactatatcgcaacacgaagcatt

SEQ ID NO: 120 - DNA (genomic), 688 bp, PORYPHYROMONAS GINGIVALIS; double-stranded, circular
  misc_feature 1...688
  hypothetical: NO
  anti-sense: UNKNOWN
tccccgggaaatccctcttttcagtatgcaacactccggaaataatcgccgcgatatagttgctcttgcccgttccctcaccacccgtaatgcagaacagattgtcgtaggttcccaaaggaacgtcgttcacggaaataaccgttttggaacgatcgggcggattgttataattgatttcacacgaacttaaaagcataatggtttgtgtatataattgttccaaatggtcggatatcagcttcctgaaatcttctgtgctgtttcccagcttgaagtaatcggagatatctttctcttgtttgttcccggataaaggcaattcgatccgctgtaatttatggtgagaaaaacgttcgcaccagcgtgtagaggcttttatgcccgtttcgtccatatcgtacaaaaagaaaatatgcctgaaccttcgtgcaagcatttcgatgacggattcttcgatattgcctgtctcactgttgaaacagatggcatggaatccatgagaggcaagggataatacatctttctctcctcccgtgatgaaaagtatatctcctctttgcggaagttgctccatcccgaacacataggtttccggcaatattcccccgtaaacgaaccggcattgactgaaaggacgatatatctttacatagtctttgcgcaggaagccgaagatcggctcttt

SEQ ID NO: 121 - DNA (genomic), 461 bp, PORYPHYROMONAS GINGIVALIS; double-stranded, circular
  misc_feature 1...461
  hypothetical: NO
  anti-sense: UNKNOWN
ttggggattcacattacccctgctgcggtcgaagtccgtagcgtgtacatgaaccacgagcggcttccctgtaaccgttttggcatgtatgccggccggataggtgagccagtcgtgggagtggatcacgtcgcacggtatggtacgcgctatcacgcctgctacgatggagtaattattgatctcttccagcagattgtccggatagcgtccggaaaattcgatacagccgagggcatccgncttcttgtagctaaaatcggcataaatgttgctgcgcagatcctcgtatgtccggagatccattcggttgcccaagagttgggtcacccgtttnggtggggacatttttgtatactatgggagtgcaagttggtgcctatgagtcggaggaaactcttgtcctcgtctccccacggtttgggaatggacgaaagtaatatccatgtcgggctgcatgg

SEQ ID NO: 122 - DNA (genomic), 657 bp, PORYPHYROMONAS GINGIVALIS; double-stranded, circular
  misc_feature 1...657
  hypothetical: NO
  anti-sense: UNKNOWN
agccatttcactgtgtccgatcgcttcgagacagcgtgcggcttcgcaacgatgactgcgttcatacagctcgtgtggatagtacggggctgagacagtggacagccaaagaaaacgatgctgaagagcagccaaccaaacgggcgactgtccccacatatccaaggtataatcattcaagggaagggcagtgtcggggatttgcagcagccgggctttcaggtttgagcggatgcgtgtcggggatagggagggttttttcaggacagaatacaaagtcctgttcgctctttgtcagccaggccggcaggagacccaaatcgcgcatcatgcttcgtactacgggtggtggtacgtagggcttcttccctatgatctccggtaccatctcgtgaccggggttgaagagcaagaggcgcggatgctttatttccgtccgaagtcggccggtatctccatccagtcgacagtattccatttatatataggggttggtaatccgatgagtagagagccaatgctctgcacgctctatgaggtcgaagatcgctgcgtttttatctgtacgagcganaagggttttgcattttttctttcgaacccagctgatagccgtcatgctatccgaatagggtgggggggggttttttttttttc

SEQ ID NO: 123 - DNA (genomic), 7077 bp, PORYPHYROMONAS GINGIVALIS; double-stranded, circular
  misc_feature 1...7077
  hypothetical: NO
  anti-sense: UNKNOWN
cagcgaaatcgggcaatcatcttatctctttcaatttattcacgattagtgcttagcttcgaattccttcattacgctaaccaaagattgtacgctttcgataggcaatgcgttgtagagagaagcgcggaaaccgcctacagagcggtgtcccttgatacctaccatgccgcgtgaagctgcaaacgtagcgaactctttctccagttctttgtactcatccttcatcacgaagcaagcgttcatgatagagcggtcttcaggattaaccgtgccgcggaagatcttgctgctgtcgatggcatcgtagataagggctgccttgtccagattcatcttttccaacaccttcacaccgccgagttctttgtaccacttcatcgtctggagtgctacataaacggggaatacgggaggagtgttgaacatagagtctttcttgatgtggatctgatagttcagcatatcgggtagaggacgatctacttgtccgagcacatccgtttttaccaatacgaaagtagctccggccggaccgatgttcttctgagcaccaccgtagatgaggtcatacttggaaacgtctatcggacgagagaaaatgtcggaagacatgtctgctacaaggcgagtcttcgtgtcgaagtccttacgaatttcagtaccgtagatcgtgttgtttgtcgtgaagtggaaataatctacgtcctcaggaataacgaaatccttggggatgtatgagaagttcttgtcttcagatgaagccaaaacctctacttctccaccatatacctgcgtcatgatcttggcctgcttgatggcgttggttgcccatgtaccggtgttgataaaggctgctttcttctttagcaggttcagcggtacttggtagaattggaggctggcgccaccaccgaggaaaagtacttcatagccttcgggcacatcaagaagttctttgaagagattgcgagcttcgagcattacagcatcgaactctttgtcgcggtgagaaacttcaagaacagaaagacccgttcctgcaaaattgagacatgctgatgcagcatctttcaaaactaagtcattgaggatacagggtcctgcggtgaaattgtgcttcttcatctgagaaaaccaatgtttaagtgggttagttattagtaatttttcttgttctgcagtcattggatgcataggtgcatctttttgccagcgcaaaggtaccaaataaaacatatcggcaaactaattccttaggaaacagctctcttgcaaactgtgatcatcagaatcattggtgtcagataaaaacgtttctttctgcggtttgcgtaagacattcatctgaggccgatgaaaaatttacgagaaaaagtatgccggtaagataagaaggaagcccccctgtggtttgcagaccgattatctgtctgtaggatttttcttttaggagtgatacactacagtttgtgacactttttcccttggggtagaatgcccttcacatcgtagataatggtgttggctgtggatgatttttcgagatcgatattcgaaaaatctctatgcgctacagcaataataatggcatcgaattttcctttagggaattcattgtgaatctttattccatatacttgctcagcgatagaaggatttgcccaaggatcgtgtactataatatttttcgtgtattcttgcagggtgctgtacgtgtctatcactttggtattacggatatccggacaattctctttgaatgtaaatcctaaaatcagaattcgtgcatctttcaccatgatgcctgctttattcatttgcttgatggtttgcgaggctatataggagcccatgctgtcattcagccttctcgcagacatcaatacccgaggataaactccatatacctgtgctcgctgaataagataataggggtctacccctatacaatgcccaccgaccaagcccggctgaaaaggtaggaagttccattttgtagctgcagcctccaatacttcgtgcgtatcaatgtccattgcattgaaaatcttcgcgatttcgttcataaatgcaatgtttacatctcgttgggcgttttctatgatttttgaagcctctgcaacttttatggaagatgctttgtgtgtgccattgaccaacacggtattatacattctatccacatagtcggctatttccggagtagaaccggatgtcactttttttatattctctactgtgtgaactttatctcccggattgattcgttcgggactgtatccggcaaagaagtccacattgtatttgagacccgaaactttctcgataatcggaatacattcgtcttctgttacaccgggatacaccgtactttcgtacaccaccacatctccttggccgattacctttccaattgtttcgctggctgccaaaagtggccgtaagtccggggtgtgattgtgatctatgggggtaggaactgtcacgatatagaagttacaatccctaatttcttcaatttttgttgtacaaagtaaccccttttgcaaggcttcctgtaataattcatttccaatttcccctgtgctgtcatatcctgacattagttcttctacacggttcgggttgatgtcgaagccgattgtcggaaattttgtggaaaacagacgagctaaagggagacccacatatcccaaaccgatgatagcaatcctaatgttattcatctctttcgtattgattattgtcaatgccttatatggtttcattttcgcacaatgagagatcgtttttttgtgcaaaggtgtggtttctccttctcgagatatgtcatctttaattccattatttcgtcttaggaaccgaacaaaggtagaatttttaaggagaaggataaatgaaaaaaccgttaaaaacatgaaagtaggagataagtgtgagaatgagtgcgcctgatctttgtgatcggcgcactcttttcgttgtttggtcctatggacagtctattggtatccggatcgtattcgggttagagccctcctcctcctgatccctgatcgccaccaccggtttgagaattgctatcgcctgcattggcagaagcacctgccggaagcggcttgccgtactcggcgaacttcagatccggagcgatcagcgtacaatcccgttcgcgagtgaccgtattgtaacgacactctgccctgaaattgacccgaacggagttgaactgggaggctttcacatcctctttcttctccactcccgatcctttggcctgtgcaatgagacggaaacaaccgatgccgtcgagcttgatcttcttgcccgaagccaattccctgcgcatgacgatgcccaaatcgcgcaggataccgaatacatcgcccgggctggctcccgaaagttctgagatttgttctgcgatgtgcagggtggaggcaatgctgccgttgatgactgtctgcggataccacagcttcttgcctgttgccttgtgggcaatacaggattgtcttcttttgaagaataacataataattgaaagaattaatgatttaataatgcggactttttctgtccattaatttaataatagcaatcgagagatcgattcggcgccatcctcttctctctgtttgcactgcaaagataagggtaaagaaactgatcgtccaaatgttttgcagaaaaaagttttcaacaacgaagggcgctttacgctttatatataaaacggcttccgtatttcttatacaaaggcttcgaagcactcttccggctttcgtaaggggagctgaaatccggttattcggcgttgtccgaatgatttatatataaagtattttcgattaatatataaatcgatttttatttatatattaatcgttttcattttgtatataaatcgaaaacgttttatatatagatcgtcagccgttcgatggggaaaagacgccgaagaaacttttcttgaaagcataaaaaagcaaggcacccgccgaagttcctgtcgaactccgagcgggtgccttgctttttgtcgtgagggatagagtcccttttcttgtttattcctttactctgccgatgtaggaaccgtctcgagtatccacttcgatgagttctccctcctgaatgaagagcggtacgcgtacttcagctcccgtctccacagtcgccggcttcaaggtgttggtggcggtgtcgcctttgagtcccggctcggtgtaggtcacacgcagcttaacgtgcggaggcagttcgcaggtgagtaccgtttcgctggtggcatgtaccatgacttctaccatatcgccgtctttgaggaactggacgccgtcgatgcttgcacccggtatggtgatctgctcgaacgtttcggggtgcatgaagttgtatcccatctcgtcctgatagaggtactgataggggcgtcgttctattctgacctcttcgacctngacgccgctgttccaggtcttatcgaggatacgtcctgtagtcacgttcttgagtttggtgcggacgaaagccgggcctttgccgggcttgacgtgaaggaattcgacgatgaagtagtactgtccctcaatttcgagacacatgccgttgcgaaagtctgccgttgtagccatttgggtataatcgtttttttaatgatgacgaaaggggtagggggcggttctcgaaatgctgccgatccttcgggatataggcaaagcctcctgttgcggaggcaaaaataagaaaaattgtccgcgaggaagagagtcgattattttcaaatggagtgtacattccggtatcaagaaagacatgataagagaaggcatcctgctcatttgatgtcgggttcctttcctatcttatgtcgaaagtgtgtttggtagggcaatttgtcctgcctgctttgcagtatggtgtgattttgtttgcatagtcttaaaaatattgacataatgacaacttcaaaagatttgttttctatatttggagtcgccgatattggcttaaataccaaggtgtagggcatgttggtttgatgtgcctgatataccgtcctaattctactaccgaatcaattatggttttgtcagaaaaagcaaagtattatgttgatcttgagcatcgctacggtgctcacaactatcatccgctcgaggtggtactctctcgtggtcagggagcttatgtgtgggatgtggatgggaagcgttatttcgacttcctttctgcttatagtgccgtcaatcaggggcattgccatccgaaaatcatagcagcactgaaggagcaggcggaaaaaatctgtctgacttcacgggctttctacaacgattgtttgggtgaatacgaagagtttatgcaccattatttcggctacgataagatgttgccgatgaattcgggtgcggaggctgtggagacagctttgaaactctctcgtcgttggggttatcgtgtgaaaggaatacccgaagagaaggctgtcatcatcgtatgcgacggcaacttccatggccgcaccatcagtatcgtttccatgagttccgatcccgacagctataccgattatggcccttatacgccgggcttcgtcaatataccttataataatatagaagctttggagaaggcattggaggaacacaaagaccatgtagctgcttttgtcgtggagccgatacagggtgaagccggtgtctttgttcccgatgatggttatatccgtcgtgctgcagagctttgccgcaagtaccatgccctctttgtggctgatgaagtgcagaccggtatcgcacgaacgggacggatgctctgctgcgatcatgatgacgttcgtcccgatattgttgtgctcggtaaagctatttccggcggggtattgccggtaagttgcgtattggcagacgatgaggttatgcttacgatcaagccgggcgagcatggttccactttcgggggattcccccttgcctgcaaagtggcgatggctgcccttacggtggtaaaagaagaacgcttgccggagagagccgaggagctggggcagtatttcagaggagagttgctcaaaatcaagagccctctattgaagttggtccgcggacgaggtatgctcaatgctattgtcatcgaaccgcacaatagacacgaggcatgggacgtgtgcgaggcaatggccgaacgcggccttctggccaaaccgacgcatcgccatatcattcgcttggctccgccactttgtatcacacgtgaggagctggcgcaagccgtggagattatcaaggaatccatcaaggttttagagtaaccattcatggctcttattcgcaagcaggccacgaaccgggtgctgatggtgcgcccggctctttttggatttaatgccgaaacggccagaaacaacagcttccagaaagaaacgggagtacccgaagcagtagcaagggaagcgaaaaaagagtttgacaactacgtcaatctattgcgcgaatacggggtagatgtatgggtcattcaggattcgaagacacctcatacaccggattcgatattcccgaacaattggttcagcacgcatgtcacaggcgaattggtgctttatcccatgtatgcacctaacaggcagcaagagcggaaattgcccgtactggctactgttggtgaaatggaaggggtggatcgtatcatcaatctctccggctacgagcgggacaattgttttctcgaaggcacgggcagtatggtattggacagggtcaatcgtatagcttactgctgctcttccgaacgtaccaatccgaaggtattagaggaattttgtcgggaattggactacaaaggattgatttttaccgccacagatgcgaatggtgctcccatctatcataccaatgtgatgatgtgtgtggcttcgcgctatgcgatcgtttgtttggagtgcatcagggacgaagccgagcgcagtatggtggtgaatagcctgaccgctaacggacaccgcatcatagccattagtacggagcaggtggagcacttcgcgggcaatatgctcgaagtggagagtga

SEQ ID NO: 124 - DNA (genomic), 1010 bp, PORYPHYROMONAS GINGIVALIS; double-stranded, circular
  misc_feature 1...1010
  hypothetical: NO
  anti-sense: UNKNOWN
gttcgaggtagcagaggtagtgtcccggcacgcagtgcatcaggaagaaggtaaggccgaagatcagcaccatcagttttccactcataggcaccaccagaagcatatagcctacaagtatgccgaatatggagctgtatttgagcaacgttaccttgtgcgagaatccggtgatggccgttgcgattcctatgagaatgagtacaaggggaagaatagccaacgggaaacgataagccagtatgctcaatgccgtaacattcagtccgatggttatccatgtcgtgtctataaatcggtctatctgtgtacgtgcatgtgcttctttctgtctcttcctattacaaataatggtcaggccccctcctactatcgggatcagcatccacagataattggctcgataaccgatatgggggtaaacgaaaaggatcagcagactcgtggcaaaagtgacgtatccccatatcaggctggggatgcctgctccgcggatcagtcgtttacgtgtctgttcgagcatcttctcgatcatctgtacgctctcttggggtgtaagctgtttttcttccatttttttgctatccgttagtggttcgtattccatttgaaaatgtctccgcaaggcatttcttaccgcttccgatgcaaatataaattagtttacagtataaaccaaatataaatgaaagaatttttgcgagagagggagaagattaaggaaggcgagagaatattttacgccggcggatataaaattggaagacgatggaataaggcttcatcggtgcaggggatagaagccgaggagaagattctcggaacgggaagcggagaagtccggtcgcatacgacggaagtcgcgacgtgcacgaacaacagcctgcatatggcggaatttgccggtgagcaagaaaaccatggcggagaggaaatccagtagagcgcggatgcgcatggtgggcttgagggctgtttccggcaaattcttgtacagcatcagcagattg

SEQ ID NO: 125 - DNA (genomic), 1116 bp, PORYPHYROMONAS GINGIVALIS; double-stranded, circular
  misc_feature 1...1116
  hypothetical: NO
  anti-sense: UNKNOWN
aacagggagccaagcgtttgcgggccctcttcttctctgaccacgaggaaatgccacgggctggtaattatgtgccgaaggagctatgcgtccggcttcgaggatggccatcaacttctcttcctccacaggacgatcgataaacttgcgtacagatctgcgcgtgcggaagaaatcttctatcaaacgaaaatcttgaggaatctgtttcattatatctctttctctattttatagttgtttctgtccgaagcctgacggctgatcatctcaccgacaaatccggttaggaacagttgcgtgccgataatcatcgccgtcagcgcgatgaagaaataaggccgatccgtcaccaaaggtgcctgcgtatgcatgattatagcggacaacttattgacaaggacaacggccaaagctatgaagccgattaggaacatgcctgaaccgagcagcccgaagaagtgcatcggcttgcgtccgaacttgctgataaaccaaagcgtaagcaaatcgagatagccattgaaaaaacggctgataccgaacttgctcgagccgtatttacgcgcctgatgctgtactaccttctccccgatgcgtccgaaaccggcggatttggccaaatatggaatgtaacggtgcatatcgttgtacaactcgatattctccactacctcgtgtcggtatgctttcaaaccacaattaaaatcgtgtagcttgatgccggacagctttcgggctgtagcattgaaaagctttgagggcagattcttgctgaacagaggatcgtaccgcttacgcttccaaccgcttaccaagtcatatcccccttctgtcaccatccggtacagctccgggatctcatccggactatcctgcaaatccgcatccatcgttatgactacctgcccctgtgtgcgggcaaaaccacattggagaccggccgacttgccgtagttgcggcggaatttgatccctttgacctcgggatgctctgcttgcaaacgttcgatcacacttcaggagccgtcggtacttccatcatctacgaagatgacctcataggaatagccatgctcattcattacacgcctgatccaagcaaaaagttcggga

SEQ ID NO: 126 - DNA (genomic), 526 bp, PORYPHYROMONAS GINGIVALIS; double-stranded, circular
  misc_feature 1...526
  hypothetical: NO
  anti-sense: UNKNOWN
ggctacgatcggtagcgtgggcaactctgaccatgctctggaaaaatcgggaaaggccggtcgttctcgctggttgggtcgcagacctcacaaccgaggcgtggtgatgaaccctgtggatcaccccatgggtggtggtgaaggtcgccagtcaggaggtcatccccgttcacgcaagggcttgtatgctaagggcttgaagacaagagctccgaagaagcattcttctaagtacatcattgagagaaggaaaaagtaatctgatttaatcaaagaaaattatgagtcgttcacttaagaaaggtccatatattaatctcaagctggaaaagaaggtcttggcgatgaacgagagcggcaagaaagctgtcattaagacgtgggctcgtgcctcaatgatttctcccgacttcgtgggacataccattgcagtgcataacggaaataaagtttattcctggttttggtacccgaaaacatggtggggcataagttaggggaagttcttttctacacgtacttttcc

SEQ ID NO: 127 - DNA (genomic), 312 bp, PORYPHYROMONAS GINGIVALIS; double-stranded, circular
  misc_feature 1...312
  hypothetical: NO
  anti-sense: UNKNOWN
ttgcttcaatgcttcatattgagacatctcttgattatagctcattttgtacacaatgttgtatttgtcatctgcatcaacacttgacatcaccataggagcgtgagacgtaatgataaactggagcctggggaatgccttacgaagtcccttgagaattgatgcttgcaggcgagggtgtagatgaaggtctatttcatcgatgagtactgtcccctcggacttgagagctgaatcagattgatataaagtctgattgagcaaggcgcatctgaaagccaaatctacgactatgctgatcactcggcgtta

SEQ ID NO: 128 - DNA (genomic), 4605 bp, PORYPHYROMONAS GINGIVALIS; double-stranded, circular
  misc_feature 1...4605
  hypothetical: NO
  anti-sense: UNKNOWN
ttcgaaaggtctgaccctaatgaatgcaaagaacgccgttgggtatgtgctgtgaagctgactcgtgcagctcgtggtgcagccgtgaagaaacagtaaaaaaaacgtacaagaagcaagccggagcttcgatcgaagttccggctttctcataacgaaggagagccgcccctgatacccctgaagtggggcaacggaggcggctcttccatattcgagagtcctattttagtcgtagcgtatgaaatacctgatcgtcggccttggcaatatcggcggagagtacaacggcactcgccataatgtgggtttccggatggtgaatgctctggccgaagacggtggagtgcagttcgtggaagctcgttacggagcgatagcgcgtatgcgtgtgaagaatgcggagctgatcctgctgaaaccaaatacatatatgaatctgagtggcaatgccgttcgctactggatgcaacaggagaatatccctcgcgaacaggtgcttgtccttgtggacgatttggctttgcctttcggcactttgcggctgaaacccaagggaagcgatgcggggcataacgggctgaagaacattgccgaggtgatgggatcgatcgattatgcccgtctgcgtttcggcttgggcgacgagttttccaaaggaaggcaggtggacttcgtcctcggccgttttacccccgaagaagaggagaagctgccggagctgaccaagcatgccgtggagatcatcaagagtttttgcctggccggtatccaaaggacgatgaaccggtacaactaaaggagatggaagaggtaaggatagaccgttggatgtgggctacgcgtatcttcaagacacgaacgatagccacggatgcctgcaagaaaagccgagtaactgtgaacgggctgcaagccaagccttcgcgtatggtacgtgtgggcgacgtcattcaggtaaggaagccaccggtgacctattcctttcgtattctggctttggctcagaatcggatgggtgccaagctggtgaaggactttctggaaaatatcactccgcccgaagagtatgagatactcgaaatgcaacgcatttcgggctttgtggacagagccaagggcaccggtcgtccgaccaaaaaggacaggcgagagctggagcagtttagcgaagagatgcccgatctgccgtactcgttcgattcgttcgactgggatgaagaagactttgccgaagactgaagctccctcttctgtaggtaacggttcggacagtccgatcgaattcgatgccatcatcaggcaagtacccgatatggatgccgcatacgtagagattccatttgacgtcaagacggtatacggcaaagggcgagtgagggtgaacgccactttcgacggttatccctatacgggatatatcgttcgtatgggcttgccctgtcatatactcggtttgcgacaggatattcgtcgagccataggcaagcagcccggcgatagcgtctacgttaccctgctgcccctctgaaatatcccctccttcggtcggggcggtttgccttctgcgagtcggaaaggagtgaagaatagaccttgtgcaacggatgaatacacttccttcgtcggcagcaaggcggaaataaatgattaagtttgctttgtctccgctgtgttgagatgctattcgccggagatacggttacattaagttcagcttattattatggcaaagagtgcactacatctggcgcggatgtcctaccagcctaaaatgcctgcatctctgcagggagcagtgaagataatagaaggaaaagctacggaggcggtttcggacaaagaagagattgctgctatttttccccgcacatacggcttgccgcttatttctttcgcacctggaggagagcggacggagtatcctcctacgaatgtgggggttatcctttcgggcggacaggctccgggtggacacaatgtgatagccggtctgttcgatgagatgaagctgctcaaccccgatagccggctcttcggatttcttatgggaccggatggcctgatcgagcataagtatcgcgaactgactgctgaggtaatagatgaataccgcaatacggggggcttcgacatgatcggatccggacgtaccaagctggacaagcccgaacagttcgaagccggactggagatattgcgagagttggacatcaaggcattggtcatcatcggtggcgacgactccaacaccaacgcctgcatcctggccgagtactatgcctcgatcgatgccggaatacaagtgatcggctgtccgaagacgatcgacggcgacttgaaaaacaaacagatagaaacctccttcggcttcgacacggccgccaaagtctatagcgaactgatcggtaatatccagcgcgattgcaattcggcccggaagtactggcacttcatcaagctgatggggcgttcggcatctcatattacactggagtgcgccctccagacccaccccaatatctgtatcgtatccgaagaggtggaggccaacaattactatctggacgatgtggtgacctatatcgccgagaccgtggtgcgtcggtcggaggcaggaatgaacttcgggacggtactgattccggaggggttgatcgaattcctgccggccatgaagaggttgatcaaggagctgaacgagtttctctcccaaaatgatgccgaattcaagctcatcaaacgttcggcacagagacagtatatcaagaacaaactcagtcccgagaattcgcgcctgtacgacagcttgccggtggatgtggctcgacagttgattgccgatcgcgaccctcacggcaatgtgcaggtttcgctcattgccaccgagaagctcttggcagacatgacggctcagaagctggccgaatgggcggaagaaggacgatttcaggggcggttcagtacgcttacccacttcttcggctacgaaggacgctgtgccatgccctccaacttcgatgccaactactgctactgtctcggacgtgcagcttctatcctgatcgcagcgggaaagacgggctacatggctgcgatcaagaatacggcagatcctgtatccgaatgggaagccggcggcgtgcccatgacgatgatgatgaatatggagcgtcggagcggaaaaatgaagcccgtgattcgaaaagcattggtggatatggatggtgaaccgtaccgagcattgcgcgagatgcgtcgcgaatgggcgttgagcaccgagtacgtttaccccggcccgatacagttcttcggccccgaacatgtatgcgatagccccacgatgacactccgcttggaaaagaacgatcgctgactcttccgctgcattagtcgggttgataagcagttgcttctgtttgttttgtcgaaaaaaaatgtttttctttgcaataagtctcatttaaaagaatcgcctatcgacgcatatctaccttctgaacaataaataaagaggattctcctatgagcagtttccacaagctgactgatgatgaattggtcagcctttatacagaaggatgcgatgaggctttcgatgtcatactgtcccggtatgatgctgtagttcatacttacatccgtttttccgtgagcgatgccgatttggcggaggatatttttcaggacacttttatcaaggtgatccatacgcttcgtcgcggacaatacatccccaccggcaagttcaaagcttggctgctacgccttgcgcacaacctcgtgatggatcactaccgccgggtcagaggggaaggagccagattgcagtctttcgatgatgacgacgccgctcctgtcgaaaaggtggcggacagcaatctgacggcggaagaacaactgatcgaactggctactatcgaagagctggaacagtacctgagcgtcctgcccgaagtgcagcaggaagtagtgagaatgcgctactgggaggacatgagcttccgagagattgcagatgctaccggagtaagcatcaatacggcactcggccgaatgcgatatgcgctgatcaatctgcgcaaaatgatgggcatgtcggcttagtcgatattccatacaataataaagcagtcgtaagcgttctctaaaagaatggaaaaaaggagaatgactcctttcatccttaacccttttggcgaatatgcttatgacagacatctaccgtattcttgatcacaaaaagctgcaaatcgttttcgatgcagcagaagagcgatgcagcctcaaacacaaacaaatccttgacaagctcaaacttatggcccgttcacgttgctcgtgatagcagctgtttccttttttgcacaagcaataaggaatagcatttcggagtatcccctaatgaaaagatatagcagccgaaactgtgcagagatatgaaaacctgtacagtttcggctgatccctttgtggataatcgtaactttgcagcattacatataaaaaagagtttttagaaaccgatgaaacccacactttttgttttggctgcgggtatgggcagccgctatggtagtctcaagcaattggacggcataggcc

SEQ ID NO: 129 - DNA (genomic), 504 bp, PORYPHYROMONAS GINGIVALIS; double-stranded, circular
  misc_feature 1...504
  hypothetical: NO
  anti-sense: UNKNOWN
cattacagcaagcatttcacgttcataacctttgagccaccctctgagattgtccggtatacgggccgcatcgaagtgccccttgaaagcatatccgatcacctccgggaaccgatcatccgctgcgacgaggagaaatccgtctttctctcctcgattgaaaacgaagaatagtgcctcctctctttctgcagctttgtaaacgaaatccatccggagactcgctgtcgatgaagacagcgtgggttgtcgtttggcaaaaaagttcttagccgtctgttcggctttggatcgtgtcaccggtcctgcctggagcatagggagacacagtaataatagccctaaggtgtagaagatacgtttcattattgcattttgttttgttgttcgaagcaggagaggcagaagaagcgataatcccgtcatcctctttaagccgcactaagataaaaaagagcattattaagagtttgcagaaagaaaaaaagggatacttgcgcatcc

SEQ ID NO: 130 - DNA (genomic), 702 bp, PORYPHYROMONAS GINGIVALIS; double-stranded, circular
  misc_feature 1...702
  hypothetical: NO
  anti-sense: UNKNOWN
ggatatcttccgtggtacgctggacggtctgacggaagaaaaccgcctgcgattcaacaggcggatgtgcggaggcaaatcgctgaaacacctgttagaggcactggcagcgcgggaaaccgacgaaattaaagcagagttgggacgcgtctacgaggaagaggagaagaggctgaaaagcgatgatcctcaccctgtcgctccgcttagctgggataaagctctgataggagcaaaggatcggatcataccggctaagaatcaacaggctttttggcagatgcgaggctgtcggaacatagagaccgtagcggaaggcgatcactatttgtttaaccgtttcaccgaatgggagcagctttggagttgagagaggtagacagcgaactggtcatcaaacggtttacttcggctttgccctactacgagaagtatgccgtggcgcagcatcgtataggggagcggctggccgatcttctaacggctacggggcgtcaccatttcgaacatgtgctggaatacggctgcggctgcggtgtctatacgcgccaactggctcaaaccgttacggtaaagcagtggacgctcaatgatttatgcccggtctgcgaggagtatatacgcgtaagctctgtttctttctatgcaggcgaagccgagacaatgccccacacggatacttacgatctgatcacctcggca

SEQ ID NO: 131 - DNA (genomic), 782 bp, PORYPHYROMONAS GINGIVALIS; double-stranded, circular
  misc_feature 1...782
  hypothetical: NO
  anti-sense: UNKNOWN
cgagcgtcgctatccggccttcggcaacctggtgcctcgtgatgtggccagccgtgctgccaaagaacgttgcgatgccggttatggtgtgaacaatacgggccttgccgtattcctcgacttcggcgatgccatcaaacgtttgggacgcgacgtggtggagcagaagtacggcaacctcttccagatgtatgagaagatcgcagatgagaatccgtacgaaacgccgatgatgatctatccggctatccactatacgatgggtggtctctgggtggattacgagctgatgactaccatcccgggcctgtttgccatcggagaagccaacttctctgatcacggagccaaccgtctcggtgcttctgctctcatgcagggtctggctgacggttacttcgttattccttatacgatgcagaactatctggccgatcagattcaggtgccgcgcttcagcacggatcgtcccgaattcgaagctgccgagaaagagttgcaagaccgcataacccgtatcatgaatgtcaaaggcaataagtccgtggacgaccttcacaaggagctgggccacatcatgtgggacaatgtgggaatgggacgagacaaagccggtttggaaaaagccattgtgaagctggacgagctgaagaaagagttctggagcaatgtctatgtgccgggtgaagccaatgaccttaacgtagagctggagaaagcccttcgattggcggacttcatcgagataggtacgctgatggcgcacgatgccatggaccgcg

SEQ ID NO: 132 - DNA (genomic), 675 bp, PORYPHYROMONAS GINGIVALIS; double-stranded, circular
  misc_feature 1...675
  hypothetical: NO
  anti-sense: UNKNOWN
cggcaagacctatacaacagcttctatcgctgtgcatatgtgcaacaagaactttacagattataccgaccacagcaaagtcatagaagagtacgaacgcctgagagatactggtcaaatagcattctgtaccttccaccagtcaatggattatgaggattttgtggaaggattgaagccagaagtgaaaagtaacaatgtggaatacaatgtggaaaatgggaatcttcaaatccatctgtgaacaggcaaagacaaaggaagaagcagatatcattacttgtattgacaagtatctgcagtctatcaagggttatgaaaacaagaagaaaattccaacgatttccggtaggtcagatctgtgggtatggtggatagagggtaatgacacaataagcactcgcagtgccatttctaaaagtgaaaaaggggagcagtattcactatcaccacttaacattgagaaagtcaagctgcaggcaattggtgaagctatagagaataactggcgacagtatgcacaagcatttatcaatgccgtaaagaaagagtaccaacttgacaaacaaatttcagacaaaccttatgttctcattattgacgagataaaccagagggtaatgtgtccaaaatattcggagaacttatcaccttacttgaagctggataagcgta

SEQ ID NO: 133 - DNA (genomic), 858 bp, PORYPHYROMONAS GINGIVALIS; double-stranded, circular
  misc_feature 1...858
  hypothetical: NO
  anti-sense: UNKNOWN
ttgtgacagattaccatcggcacaccgagatgtttggcatagctattggcacgcttcgtacctccgacatcaggcgtagctactacgaggttctctaagggcatattcttgcggatgtattccatgaaaaccgtagagccgtagagatgatccaccggcacatcgaagaaaccttgaatctgatccgcatgtaggtccatcgtgatcagacgggtaatacctgccttgcttagcaggtcggcgatcagcttggcgccgatagatacacggggcttgtcctttctgtcctgtctggcccatccgaagtaggggatgacagctgtaatgtagtgtgcggaagctcgtttggctgcatcgatcatcaggagcagcttcatcaggtggtccgaagatgggaatgtggactgtacgaggaagacatcccggccgcgaatgctctcctcataggatacggcaaattcaccatcggcgaagtgctcgatattcattcgccccagagggcaacccagactgttgcagatcttttccgcaagataacgggaatttgtcccggagaagacagaaaagttgttttcgttgttcatctttgatatggtgtagagttatcgttccattgccggcaaatcgaagccgtcagaccacctccgaggcgactgctgacggacatgatgcaaaagtaatatatatacattatgtatggaagctcgaagaagaaaagaagatcgggatgaagcaatggcagaggcgttgctgtcacgctcgattcggctctatcgcctctgtctcgtgcctccgcgcctgcgtccgttcgaagcggtttttccctgtcttttgttcgtttcggatcgaccagaacgc

SEQ ID NO: 134 - DNA (genomic), 929 bp, PORYPHYROMONAS GINGIVALIS; double-stranded, circular
  misc_feature 1...929
  hypothetical: NO
  anti-sense: UNKNOWN
gatccccgtccggtcggtgccagcagttcacaatctgctccctgctcgagaatagtctgcaccacagaagcgataagctgtgtcttacccgtaccggcatatccgcgaagcaaaaaaaccgaataaggttccctgtcgaacagatactttgccaaagatcgaatagccgaatcttggctttgtgtcggggtaaacggcaaatttttcaatatttgctcggccaaataattgtccatctttatacaaatcgtatatttgcggggactaagttacttcctttgaacgatatcctcggattcggtggggcaatacggattaggaagcgtctttagaagagattttaatacaaaacaaagtaagataacgatgaagactttaatcaagattttggtggctgtagcagtcgtggtgttggcatatctcaccgtgatgagcatatatacccccgttagtttcgacaaagattcaggccagtccgtgaaacaagctatccaaaagaagctgaaaaatatagctgactatcaagctgcattcgaaagcatgtatggtcgctatgccacagcagatgaattggtaagcttcctcgctaacggccgtgtctactacgtgaatgccgaaggcgaatacaccgacgacatgcgcgacaaaggaatgaccgaagcacaggcagctcgtgcaggcttgctcaaacgcgatacagtgtgggttgcagccaaggactctctgctcaaaggtattgaccccaatacggtcttggacattcccggttttgccggcaaaaagattttggttgaggtaggctccatccaacaggagataggtcgggacactatagatgtatccgtatttcaggcatcggtacctttcgtcgactacctcagcgatcaggatcagattcgtctgaagatgaaaataaacgatgcagaagc

SEQ ID NO: 135 - DNA (genomic), 1190 bp, PORYPHYROMONAS GINGIVALIS; double-stranded, circular
  misc_feature 1...1190
  hypothetical: NO
  anti-sense: UNKNOWN
tcctgggatcaagcaaattcaggtaggtgagcctagcccctaccagcccgtttccaacttgacagctacaacgcagggtcagaaagtaacgctcaagtgggaagcaccgagcgcaaagaaggcagaaggttcccgtgaagtaaaacggatcggagacggtcttttcgttacgatcgaacctgcaaacgatgtacgtgccaacgaagccaaggttgtgcttgcggcagacaacgtatggggagacaatacgggttaccagttcttgttggatgccgatcacaatacattcggaagtgtcattccggcaaccggtcctctctttaccggaacagcttcttccaatctttacagtgcgaacttcgagtatttgatcccggccaatgccgatcctgttgttactacacagaatattatcgttacaggacagggtgaagttgtaatccccggtggtgtttacgactattgcattacgaacccggaacctgcatccggaaagatgtggatcgcaggagatggaggcaaccagcctgcacgttatgacgatttcacattcgaagcaggcaagaagtacaccttcacgatgcgtcgcgccggaatgggagatggaactgatatggaagtcgaagacgattcacctgcaagctatacctatacagtctatcgtgacggcacgaagatcaaggaaggtctgaccgaaacgacctaccgcgatgcaggaatgagtgcacaatctcatgagtattgcgtggaagttaagtacacagccggcgtatctccgaaggtttgtgtggattatattcctgacggagtggcagacgtaacggctcagaagccttacacgctgacagttgtaggaaagacgatcacggtaacttgccaaggcgaagctatgatctacgacatgaacggtcgtcgtctggcagccggtcgcaacacggttgtttacacggctcagggcggctactatgcagttatggttgtcgttgacggcaagtcttacgtagagaaactcgctatcaagtaaatctgtcttggactcggagactttgtgcagacacttttaagataggtctgtaattgtctcagagtatgaatcggtcgcccgacctccttttaaggaagtcgggcgacttcgtttttatgcctattattccaatatacttctgaaacaatttgttccaaaaagttgc

SEQ ID NO: 136 - DNA (genomic), 1092 bp, PORYPHYROMONAS GINGIVALIS; double-stranded, circular
  misc_feature 1...1092
  hypothetical: NO
  anti-sense: UNKNOWN
cgtgagttcgatataaaggaatggcacaacacattggttattagtgtgttttattttccacacagtgtttttcagacacttatattgctttcagatggctttttatctacatctgaagcccaatgacttggaagccgccccttcttcccgatcattatgcagccggagaatcacaaaagagtatgatttacagctacttgttatttttatggtatgttcgcttagatcgaactggcgttgaataagagaatcacgtcataagccggggcaccgatggcattttgtcgcttcgtgtatttcttgttgatcagcgtcctgatcggacgccaatcgataagcctgtcaacctgattgaggaagtcgttttgtgctttgcgataacgctttgaaaggagtgcgtctgcaaatgttacatgctcatcggtattcttggattggcatgccatgggaggaatattatgctgtttttaatactcaaatatacaaaataactccgtattatacaatgaattaacaaacaaaatacacaccaatcgccgtgcaaaggtctcgaaaaggtactcaaaagagtggcatatggatttagagatcaacaatacttcaacctaagactctatgccttgcaccacgcctccgtcacgctgaatgtcggatgaaccatattttcttacatttgtcgcccgatgaagctctctgtcggaagttggatgtcgctgccgagagagccgattgcttgaatagaactacatggataatagactataacagaacatgtgcaccgaacacctttatacccccgatctttccggccgatcctttcgcgcccataacctaccatgtcatttcgatattcggacaaacagtataaacccctatgacgaataagtaggaataaaccctcttaatacttctcctaaaggcataggcacccgcacggttcggccacgaatcgtgcgggtgcctcttttatttcagcttccgaaagggcctttttcggtcttcgatttatatacaaatgacttccgatctatatataaatggaaaacgatctatatataaatcaaaaacaatctatatatagatcgaaaatgg

SEQ ID NO: 137 - DNA (genomic), 2197 bp, PORYPHYROMONAS GINGIVALIS; double-stranded, circular
  misc_feature 1...2197
  hypothetical: NO
  anti-sense: UNKNOWN
tggctcatcggctctctctcgattcggatatccaatcgtagagctatcgaggccggtgcaggtctgcgcatgcgttcagccacccgcgccggtataagcggcgaggtcactgctgctatctgtatggctttgagcgaatcgcagaatgacgttcatgatattgagaatgccatattgactatccgacgggtggagcgcaagtattcaccatggagttctaagatatatggactgagatctcctatcgaaaggcatatgttcacaagtaaacatgatagacaatgaaagaaaaagataagaaagctgcccccactaaaaaagcaaaagctactacccccaagaccggaaaggcgaagaaaggagctatgacggacgacatctatgctgctatctcggtggctctctatcaagagacctatgaagctcatgatgctgaacctatgaggctcacgatcaagcgtcatcgtcattctgcttggagcatgaagacacttatgcttcgtcagcttcctaaataatctcattcaatcacgacattaaaaacatgacaaaacaatgaaagagtataaatataaaatcaacggtaacgaatacaatgtcgttatcaacagcatcgaagatggattggcagacatcgaagttaacggtactccctataaggtggaaatacttaccgagaagaaaaaagcatcgaagcctgcaatcaaacatccgaccgtcacggctgcacctgtagcagctgcacccgttgctcctgcagtttcagccggaggacaaggtacaggcgtcaagtctccgcttcccggtgtcatccttgacgtttgcgttaaggtcggagacgaagtcaaggtcggccaaaaggttgctgttctcgaagccatgaagatggaaaataatatcaatgcggatcgagacggtaaaatcgttgccgtgaaggtcaacaaaggcgattccatcctcgagggttctgatatcgttataatcggctaatgatatgaccggattcggcagcttcttagcaaacaatatcgaggtattcctctcttacacaggcttcgccaatgccacactcggccacttggtgatgattctggtcggattgctattcatttttctggccatacggtatgagtttgagcctatgttgctcattccgatcggatttggaatcctcattggtaatatccccttcaaagatgccggtctgcagatcggtatttacgaagaaggatcggtgctgaatatcctctatcaaggggtaactaaaggatggtatccgccactcatatttttgggtatcggtgcgatgaccgatttctctgctcttatcgctaatccgaagctgatgttgatcggtgcggcggcgcagttcggtatcttcggtgcctacatattggctttgtatcttgggttcgaacccaatcaggccggtgctatcggtattatcggaggagcagatgggcctacggctatctttctctcgtccaagttggctccgaacttgctgggtgccattgcagtctctgcatactcctatatggccttggtgccgatcatccaacctcctattatgcgtcttctgaccacgaagaaggagcgtatgattcggatgaaaccgccacgtgccgtgtctactacggagaagcagatattcccgatcgtggggctgctgcttactacttttcttgtgccttcgggtttgcccttgctgggaatgctattcttcggtaatattttgaaagaaagcggtgttactcgccgtttggctgagacggcacgtggcccgttgatcgatgtcattaccattcttttgggcgttacggtgggagcttctacccaggccactcagttcctgacatggaactcgatcaagattttcattttgggagctttctctttcatcattgctacgatggccggtgttttgttcgtgaagattctcaacctcttcttgcgacacaagctcaatccattgatcggcaatgcaggggtttctgctgtacccgactctgcacgtatttcacagatcgaaggcctaaaggccgatccgacaaactacctgctgatgcatgctatgggacctaatgtagccggtgtgatcggctcggcagttgctgccggtatcctactcggattcctcgcctaagaaagtttccataatctcaataagccgcccattgaacagacttttctgtcg

SEQ ID NO: 138 - DNA (genomic), 963 bp, PORYPHYROMONAS GINGIVALIS; double-stranded, circular
  misc_feature 1...963
  hypothetical: NO
  anti-sense: UNKNOWN
tacagcttatgaaaaagttattctctttgagtgcggtcatcgtactcttaatttccttgcattcttgcgcgcctcgcatcatcaccgagctgaacaaacagtaccctcctttgcccgagggaacacctattgcggtctacgaactcgaaaacggtaagcgtcccccttcggaggctgagctggtagggaaagtgaggatcgccgaatccggtctatccccgggagtctctcctactcggaggccgtgcagattgctcgcgaagaaaccagaaaaagcggtgccaatatcctgtacgtgatcaatcaccaacgaccctctatcttcggcagctccatgcatcagataggcgggcttatgctcttgtcagattctgtcgtgaggaacgagggagaaggttatcccgactcgcccctgtacgattcgggtcaaagggggaaaatcggctctcggatcaaggctcccgtacacgacctctcgctccatttcggcccctctatcatcacgaatcggacaaaagggctgtcttattcggagcagcagctggagaaaaagctaagcaacggactttcgttcgtactccaatataaatgtcacccgaaagggaacctctacggattcggtctgatcgcctctcgatatgaagccgacatcactaagaaaatcgaataccagggtatcggattcgccaatcgattggactatatcgctcccttattcagcatgagtactgctctttcggagcggtggttgcttgggataagtttcggcttaggttatttgggcttcaaacaaacgctgaccgacatatccgacccgaagagggaaggttacttctccggcagcacagtcggagccaatacggcactcaacgtaggatacaagctgaacaaacatttaggcatcgggggagagatcatgatggtcggtggcgttttccatccggataacataaagatgacgac

SEQ ID NO: 139 - DNA (genomic), 749 bp, PORYPHYROMONAS GINGIVALIS; double-stranded, circular
  misc_feature 1...749
  hypothetical: NO
  anti-sense: UNKNOWN
gaggatgtaaagaacgacatcttaccgatacgtgccgaaagaataaagaccaaagccaactctgcaatgatcaatccccacagcaatccgggattcattatcatagtatatatcaacgaactcttagcaacgagcatggctgtaagagccgtgataccgagtgcaccaaacatccatgtaaagacatggcgcatagttgtcgtttggagcgtactatccacatagacagtggattgattgttcaattcgttaaagttcataccgcgtttcgttatttgcttatattttattattctgtttcctatggtaattcaacaaggatctccggtaaaggttccaccacttcaccgccccctgcatcgaaatactctacattctgatccatcatacatggctggaaatcctgtgggaactcaaatttctcttccgttgtatagcccagcttgggatcagcgtatacccgcttgagaaattcggcaaaaataggcaacgcagaagcagccccctgcccattggacatagagtcgaaatgcacagacctatcctcaccgccaacccaacagccggccacaagagaaggagtaaagcctacgaaccagccatcactgttattctgtgtggtacccgtctttcctcccatatcgagtttgaatccatagcgatacctcagtctgctaccggtaccgccatcgactacggacttcaacatatagagcatcttgtatgccgcttcaggtgggagtacttcc

SEQ ID NO: 140 - DNA (genomic), 683 bp, PORYPHYROMONAS GINGIVALIS; double-stranded, circular
  misc_feature 1...683
  hypothetical: NO
  anti-sense: UNKNOWN
ccgtgcgcgtagagctaaaatcctctatagggataaaggtcgaatcagatactgtattttgctcaagcaattggctataaatagcattctgcgcttattggattttgttttattatctgcattcccagagggaagagtcggctgcagggcaataaggatcgcagtggaatcggtttctgcctgtcgcacatcgctcagcaaatccacaggcttgagttgccagctccctatctgctcgggcagatagaataaagcacccaaaagaattgccgttgcagcaagcaacaaccaaaaacgagccatttgattacgcgggccttccatagaataatcttgtgtcggatttctcttctttgtagaagaatcaaaaattgtgcgcaaagataaacgttacacaagtaacttgtattaaccatcctgaaacgacaggacaatcgcatttgaaatataagcctgatgatgctccgtccggaataaacacgaattaatgtgttagagatcctaatagtagaaggaagagaccaaggatacagagtacaacctttcaaatacgatagccctctgtcgaagagaccggcctcttcggggaattttctgtagtctgtgttgcgcttactatcggaaattacaatcacgggtgtctttctattataagaaatgagtcctgatcttcccaaacaagg

SEQ ID NO: 141 - DNA (genomic), 838 bp, PORYPHYROMONAS GINGIVALIS; double-stranded, circular
  misc_feature 1...838
  hypothetical: NO
  anti-sense: UNKNOWN
tggccgaactggctcagcagatccatgcagaaggtttcttctttctcgcgctatggtcgatgccggtctatcgggtcatgaacgtcaggtaggacaaacgggtaagactgttcgccccgacatctacatggcctttggtatctcaggtgccatccagcacttggccggtatggaagagagcgattatatcattgccatcaacaaggacaaattcgctccgatcttccaggtggccgatcttggtgtagtcggcgacttgcacaagattgtacccattctgacggctaagctgcgttctgccatgcaggacaagtaagagcctgttagtataacaaaccttgtagaggagccgatgaggcgaagggcttttgtggctcgtcgcattcattcggctcctttttcatccatcgaagagagttatggaatttcacaatctgatcatccaatcgaaagatggtatcacgacgctgaccatcaacaaaccggagacactgaacgccctctcctctgaagtcctttccgaattgaagtcggccattgccgttatcgctacagaaaagcctcgagtgctgatcattaccggaagcggcaaagcatttgtcgcaggagcagacatagccgagatgcaacatctgagtgcagccgagggaaaagcctttggagggcttggagcagaggtattccgaaggatagaagaattgcctttccctgttattgcagccatcaatggctttgctttgggaggcggatgcgaattggccatggcttgtgacatccgcatagcttcggcttaaagcccagtttggtcaagcccgaagtcggattgggcatcaacccc

SEQ ID NO: 142 - DNA (genomic), 820 bp, PORYPHYROMONAS GINGIVALIS; double-stranded, circular
  misc_feature 1...820
  hypothetical: NO
  anti-sense: UNKNOWN
gctgcgatagcgtcagttcgacgtgagaaaaggaaagggagctttagcgtgcagaggcaggattgctatttcaatatatcggataagccggcgaataatccgaaaccggatatcaccataaaaataacggctacgatgcggttgaaccaccgtatgccaacgacattgatacgattgcgtagcaggctgaaaagataagtgataagagaccaccagccaatcgcccccaaagctatacctaacatgccggaggtataaccgactaacatcctccccggaacatnggtgacgaagttgaagcgggaatatagagcgataaaaaagaaaatgataaaagggttggatagcgtaaggccaaaagagcttaggacggtatgccatacagagtagttattatccttatcatccaccttgaaggtgggtgcagtccgatacagatatataccgaatagaaacatgacgacactgccgagaagctgtagccaagcctcgttgcttgtcaatgaagttcatcaccaaacctattcccagatacgtgacagtggcatagaagagatcgctaagtatggctccgataccggtgtagaatccatcgcgccgtcccctgtgcagagtccttcgaatacacaaaattccgatcggccccataggagccgacacgagaatgccaatgagaataccgtatagaattgaagtggcaaccatgccgtagaaaggcaaaatttccttattgtcctgctaagccggattgcaaagataaacattctaccctgttatatcctaatccgtttttgccggatttcttgaaaagaaaaagtcc

SEQ ID NO: 143 - DNA (genomic), 3990 bp, PORYPHYROMONAS GINGIVALIS; double-stranded, circular
  misc_feature 1...3990
  hypothetical: NO
  anti-sense: UNKNOWN
gggagagcgcatagcccgatttgcagatatagaagtactcagctatcgagccgacctcttcggcacattgacccctaagcagaggatgctttgctaccacctatcggaagcagccctgcgaggacgggatattacaaccatacagaactgccgctacaacctctgggtacgcagtctgatggagcgtatttacacccatcttagcaagtcggaacgaaccgacgacttttgccctgctggaagaatacctcttctgcatctggtttgccaatggcattcaccaccattacagcggagccaaattcattgcccgtttcagtccgggtttcttgcgggcagccctgagagaggcgggcgtggagctggagccggaagagcaggtgcttttggagcgcgtattgtacgatacccgattttctacccaaacagaccgagcagagcggcgaagaggatattatcaaggcttcttcggtcaatttctatgcaccgggtatcacccgagcccgaagcggaaagccattacaaaaacctgatagaagctcttcccgaaaacgagaaaagctgtccgccgagcttcggactgaatacccgtctgatccgttcgacttcgggcgaattgaaagacgaggtttgctgtatagacggattgtacggcccggccatagaagctgtagtcgcttccttggaggctgccataccatacactgagaacgaggaacaggccgcatgcatacgactgctgtgcgactattaccgcacaggagacatcaggctgtacgaccggttctgtattcgctgggtggaaaacaatcgtactcggatcgattttatcaacggattcaccgaagtatatgccgatccgataggcatacacggcagttgggagggactggtacacatgcaggacgaagaagccggcagacgtacgcgcatcatcagcgaacatgccggttggttcgaagcacattcgccgatcgacgcacgtttccgcaagaagaatccccatggtatatcggctacggtggtcaatgtactgaccatagccggcgacagctatcctgccacaccgataggaatcaacctcccgaatgccgactggattcgtgccgaacacggatccaagtccgtcactatcgacaatatcacggatgcatacaaccatgccgcgcgagggacaggtctgtacgaggagtttatccccgacgaggaagtacgcagacacgtagagctgcatgccgacctaacggacagcctccacaccgacctgcacgaatgcctcggacatggcagcggacagttgctccccggtgtaccaggcgatgcacttggagaacacgcctccacgctggaggagacgcgtgccgacctcttcgccctctattttctggccgatcccaaaatgatcgaattaggtcttttgaccgatcccgatgcttacaaagccaactattacaaatacatgctcaacggtctgatgacccaactcgtgcgtatcaagcgaggagaggagatagaggaggcgcatatgcgcaaccgtgcactcatagctcgctacgtcttggagcatgccgagcggccgggggcaatgtcgctggtctgcgaagagggcaagacggcactcgtgatcaaggactatgaagcagtgcgtgcgatcattgccggtttgctgaccgaggtgcaacgcatcaagagcgagggcgactataccgccggcaaagcgttggtagagcgttatgccgtccacgtggatccgctcttgcacgaggaagtgctgacgcgctatgccaagctggatattgctccgtataagggatttgtcaatcctcggttgagacccgtatataattcggagggcaggcttacggatgcaacgatagaatacacggaaggctatgccgaacaaatgcttcgctacagtgcagaatatagcttcctgcctacagacagtccgcttttgcaggaggcacgaagattgcgctcgcacctccgacgggcgatggacggtgtactatcggccagtatgcgtgagaaaggactccactacggcatcaactttggagtcactcgcgaacatctgctccgactggctcgcacggccgacgcttccgctccactggccgactatctgtggagacgcgatgtaagggagacgaagatactcgccacgatgatttttccggccgaagaactgactcatgagcaggcaacgagattgctccgagaggccgacaacgtggaacttcgcgagcaactgacagccaatctgctggagcgaatgcccgaagcgatccggagcatcggccgatggatcgagagcaaagagactactcctgacatgatgacgggagtattgacgcttgcagccagattgtttacacgcggcatctttccggaagacgtgccggcagagaaactcttaacactggccattctccatctctccgatgaggagcagaaagcggagcttcggcgcgcttccgcacttctgctcaagcggtacgggcgaggctccgcagaacggacaaaaaaagtgctgtgcctattgcccgaatcgagccaagacacagcaccggttttgtatgaattatgtgaagatatccgcttcgaactcgacttctacccaaaggacgagtaagagaagcgactatcaatcgatcatcgagaagcctgtataaggcaccagacagtcggggatgcggatgccatcggctgtctgattgttttccagcagagcagccacgatacgcggcaaggccaaggcactaccgttgagcgtgtggcaaagctccactttcttatccgcattgcgataacggcacttcagacgattggcttggaagctctcgaaattggacaccgagctaacctccaaccaccgctcttgggcagccgaatagacttcgaaatcgtaagtcaatgccgaagtgaagctgatatctccgccgcagaggcgaaggatacgccacggaagtcccaacttatctacaaggccttggacatagccgaccatctgatcgagctgttcgtaggagtgttcgggcttgtcgatgcagacgatctccaccttgttgaactgatggaggcggttcagaccgcgaacatccttgccgtacgaaccggcttcgcgtcggaagcaagccgagtaagcggtcaggagaatgggcaattcgtcctcggagagaatgacatcgcggaagatattggtcaccggcacctctgccgtggggatcagatacaggttgtccgccgtgacatggtacatctgcccttccttgtcagggagctgtcccgtaccgtagccggaatcctcattgactacatagggcggctctatctccgtgaagccggcgttgcgggcttcatccaagaagaagttgaccaaagctcgctgcaggcgtgctcctttgcccttatagacagggaagcctgctccggttatcttgacgccgagttcgaagtcgatcagatcgtatttcttggccagatcccaatgtgggagcttgtgcgttccaagctccggcactgtgccgcctgtcttcacacagacattctcctctgcggtcttgcctgcagggacagactcatgcggcagattcgggataagcagaagctgttggcgtatagcattctccagatcagctttccgctcttccagatggtggctcccggctttcatatcggctactttcgcacggatggcctctgcctcgtctttcttgccggctttcatcaaagctccgatctccttggcaatggcgttttgctccgccaagcgagcatccagactctgttgagtttcgcgtcgctgtctgtcgagagagatgacttcgtcgagaatagcagctgcatcgaagtgcttcaccgccaagcgacggatcacttcttccttgttttctatgatttgcttgagtgtcagcatagtatatcgaaaaaaacaaaaggcaaatccccaaggcggttacagcctgtagagattcgccccggggatcc

SEQ ID NO: 144 - DNA (genomic), 840 bp, PORYPHYROMONAS GINGIVALIS; double-stranded, circular
  misc_feature 1...840
  hypothetical: NO
  anti-sense: UNKNOWN
tctgcggatcagcaacggtacttccgcgacctcggcaaagagtatgccgccatcaaccctcctttctccgaacagtgaaagacnacggcaggcttacagtatcggactctcttttgaatatccccatcttctctgccatgcaaacgcaagatcgcgttcggagcagtcgcctgcaaatacgctcaagcgagcttcgactcgtcgaagagaaaaaagccctctataaagagatcaggcaagcatacagcaatgccgtggcagccgataaggccatcgcagcagccgaaaacagcaaggccgctacgctcaaggcatacgaatacgctcgcgacagcttcgaggcagggcgcttgtctgcctacgaatatgccgaggcaaaaacaaaatacgccctcagccaagtggaagaacttcgtgccaagtatgacttcatatacaaagccaaagttttggatttctatcagggcaaagacttctaaaagactcacaagaaagctatctttgaaccctcagcgaggtgttcatgagatctatcaggaccccgacatcgtagggtgctgcgtcaaaattcgttttgccacagcacccttttaacgtcagttcgacgtaagaaaacgccaatgaataattcttttcctgatcagagattgatgccctaagattctccggcaaatgtatagggggtatcctgcttctgcttggatcgaaccaacattgaaattcggattgcttttgacagaatgttgcagtccgcacaggaagatgggctataccacagggcaagatgccggtactccgtagaggatgatgggctacccccgtatggctcttcgaggtacc

SEQ ID NO: 145 - DNA (genomic), 575 bp, PORYPHYROMONAS GINGIVALIS; double-stranded, circular
  misc_feature 1...575
  hypothetical: NO
  anti-sense: UNKNOWN
ccatggcactctgatgatcgataattccagtgctttccgtatgcaggaagacgttcccctcgtggtgccggaggtaaatggggatgatgccttggtacaccctcgcaatatcatctccaatccgaactgtacaacgattcagatggtggtggcactcaagccgatagaagacctttctcacatacgtcgtgtacacgtggccacgtatcaggctgccagtggtgcaggtgcgctgggtatggcggagttggtacagcaggcggaagagttggctcggggagagaagcctaccgtggacaaattcgcttaccagttgatgtataacctgattccacagatcgacgtctttacggacaacgactacaccaaggaggaaatgaagatgtatcgcgagaccaagcgtatcatgcatagcgatgtgatggtgagtgcaacctgtgtgcgtgtgccantgatgcgtgcccacttcgaggctatttgggtggaaacggaacgcccgatcgctcccgaagaagctcgtgcagcctttgccaaagcttcccggagtgttgcttgtgccgatgagcccgttcaga

SEQ ID NO: 146 - DNA (genomic), 452 bp, PORYPHYROMONAS GINGIVALIS; double-stranded, circular
  misc_feature 1...452
  hypothetical: NO
  anti-sense: UNKNOWN
taggtatttaatgtcggatttatactaaataagtggtattgggaatactggaattgcacatgaaaaagccctcgatacataggtgcttttattcatttattatttgtgtatcagccgattattccgtgtgtttatggtatgatcaatgacacaaagctatggcacgacaaggaaaatcatctaatgaggcctttgaaaaagagaaggttatcgcttaggttgcaacttatacaaagggatgagagtggacaccgtgaacatacttcttgcggcagcagcctatgaactcaagagagctatgaaggctcttttggactttatcaaaacaatctgcgagatactgtttgctgacaatatctccctaaaagggactttttaggggatgactatatagggagtgtaaacaaagctatatagcaatcggcccaatcctatatagcaatcaaacgaan

SEQ ID NO: 147 - DNA (genomic), 5476 bp, PORYPHYROMONAS GINGIVALIS; double-stranded, circular
  misc_feature 1...5476
  hypothetical: NO
  anti-sense: UNKNOWN
aacgggggagagactctgctccggcagatgggcggccaaagaggcggcatagtcggaagcgattcgctccacgaggctctcttcgcctgctctgaactcgattcgtatcagccggctaaaaggtgggaagaaaagcatttgcctttcctccaattgttttccgataaaagccttataatcaccttctcgcaataaatccggaaaggagttggccggattgttcgtttgtatgtatagacgggaggctccgctcctaagcatgagctgatagagtagctgataagctcgttcgtaggcgcggaaatccgggaaacccaatatgctgtccagctgggtgacggctacaagacctacatgttcgttatagacttgccccttgatcagttgcgtgccaacaagtatatccacctctttcgcttccagacgcgccagagcttcgtccatcttcgttcggctcatggccatatcgctgtccattctgaggatagagacggtggggaaacgtcttttaagctcttcctctattctttcggctccataccccacaggttgcaggctgctcggctctcctacgcccgatgcccgcttgcaggagggacagatgcgcggaaggggtctgctgtagccgcagtagtggcagacgagcatacaggaatgcttgtgataggtgagactcacatcgcagtggatgcaacggagcttttccccacaagagctacaaatgatatacggagcgaagccccttcgattttggaggacgacggccatttttttttgccgaatcgtctcttcaatagctgagacgagggggaaagaaagcagttcacctgcaccgacctgtctttgacggcgcatcttgcccatgtctatgacttccaaatcgaatcgggggcgaacccgatcgtccggccaggtgatcagttcacaggctttgtggcgcacttggtggagcacctcggcagaaggagtggccgaagccaacacaacagggcagtcgtggatccggccgagtcgagctgccacctgtcgcgtatggaatcggggggcaggatcctgctgtttgtagaggtattcctgttcctcgtccacgataatcaatcgcaagcgacggaatggcaggaaaagtgccgatcgaacacccagcaccacgcaaggatattccgttgtggccaatctgttccacacttccacccttttggcatcgctttcaaaggcatgataggatagcaaacaactgcccagcctctcggccatacgtgtggacagagtatcgcttcctcctcgtttgttcgcttccggagagaggtacaggacttggcctcctgaacggacaacttcttccgtccattctaagagttgtttttctttgcgtcgaaagtcatgcgtatagaggagagaaagaggtttttgaggtagagaagccgatactgcggagtctgtagaactctcttccgattgaatggctttttcttcctcttggggctgctcccacaagcggtactcacctccgccggccgaatacatgaccgagtgtgtaacagattcggatagaaaaatccctttctttttcaaagcggaaagggtgactgtagcatgaggatcggactccgccagtagcctttgcggcatcggagaggaatatgggagggagtgctctgttatcagctctgcccaatgaagcaaaagggcggattgcttgggagcacgatgcaaactatccagaagcgaggcaaaagtcttttccgtccggaaaggctctgccagacgaacgaatacttctgacttgggcttataacggctttttacttcttcctccagccgtatggcccctcgttcgaccaaggaggtaaaagcgcgaatcgctcgtttgccgacagccttttgcagggcgtcaagcgtgtaggttcgtccttttgccgactccaaaatatcgaggagctcctcttcatcacgactaagccggctgtcggcttcgaagtccgtattataatggatgacggtatggctctcgggtagtaatgctgcaggcagagcagcacggagtacttctccctgcgtacatatgtaataagccgacagccactgccacagactcagctgtgaggcagtaactgacggcttatcgtcaggcaggaagagaacctccttgaatgaaatttgcagattgggacgtttgtcggacagtccgatgataatccccgtatagtatcgcttggctccgaaaggtactacgcaacgcatccccacgatagccttctcggctaacccctcggccaatcggtagtgaaaactaccctcaagagccaagggaatgaggacttcggcatagcgcatagctatcttctccctttcatctcggagtcatggctatgattccgctttcagatattcgtgcatggcagctgctgctttccgtccatcgcccatcgccaatatcacagtggctccgccacgaacgatgtcaccaccggcaaaaacatcggggagagctgtctgattgctctcattgacgacgatggttcctttgcttgtcacttcaagaccggaaatagttcggggaacgagcggattgggcgatacaccgatacttacaatcacttcgtccaccgggatctcctcgatagcccccgtgatcgcaacaggacgacgacgaccacctgcatccggctcgccaagctccatcttttgcaggcgcatcgcagtcactcggcctcgttcattgccgatatattcgataggattgtgcagtgtcaggaactctattccttcctccttggcgtgcttcacctcttccaatcttgccggcatttcctcttcgctgcgtcgatagacgatcatggcacgttctgctccgaggcgtttggccgtacgaacggagtccatggccgtattgccgcccccgatgacaagctacattcttgcccttgaaaacgggtgtgtcgctgtcggcttggctcgcatgcatcagattgacgcgcgtcaggtattcattcgaagacatgactcctacaaggttttcacccgggatattcatgaaattgggcagaccggcaccacttcctacgaatacaccgcgaaatcctgcttcatgcaggtcatcgtatgcgatcgttcggccgacaatcgtattcgtctcaaagcgtacgcccatctcttcgagaagattgatctccgaatcgactatactattcggaagacgaaattccggaattccgtacttgagcactcctccgatttcgtgcagggcttcgaatacggtcacgtcatagcccaacttggccatgtctccggagaaagaaagtccggccggaccgcttccgatcacagccactttgataccgttgcgaggagccatttcgggaactttgagtgcgccctgttcgcgttcgtagtctgcggcaaagcgttccaagaaaccgatggcaacagccggtttgttcattttcgtatagatgcaccggctttcgcattgcttctcttgcggacagacacgtccgcacaccgccggcaaagagcttgtctctcgcaaagtagatgctgcagccagtatatcgcctacttctatctgcttgataaaggtcgggatattgatactcacaggacatccttccatacagctcggttgcggacaatcgagacaacgagaggcttcggccatagcggcctcacgggacaaaccgcgattcacctcttcattgatcttggagctacgatagagggggtcgagttcgggcatttcagcccgtggacgcgacatgcgttctttatttttgagcgcgttgcgcagctcctctctccatggttcagagcgacgcagtcggataagttcttctgtagtcatgtcaataaggcagaaaataaggttattccatctctcggtatgcgcccaaacgcatgatcatctcatcgaaatccacttggtgtgcatcgaattcggggccatcgacacagacgaatttcgtctgtcctcccacgcttatacgacaagccccacacataccggtgccatccaccataattgtattgagagaagctatggtcggtatctcgtaacgtttggtcaggagagaaacgaacttcatcatcacagccggcccgatcgtaacgcagaggtctaccgtttcccgtttgataacgctttccactccatccgttacgaggcctttcgtcccataagacccatcgtctgtcatgatgatcacttcatcgctattggctcgcatttgttcttcaaggataaccagatctttagttctggcagccaatacgacaattacacggttgcctgctttgtggaaagcctccacgatcgggagcaaaggagccacacccacaccgcctccggcacaaaccactgtgccgaccttttcgatatgcgtactctgtcccagcggacctaccacatccgtgatatagtcgccgacttcgagttcggccaatttcttggaagatttgcccacggcctgaaccactaaggtaatggtaccgcgctttatgtcagcctgtgcaatagtcagggggatgcgttcgcctttttctccaacgcggatgattacaaaatgtcctgctcttcgcgatttggctatacgaggagcctctacttccagcttgatcacattagccgagaagtattctttggatacgattttattcatagtaacagtcacatttgcccgctgctaaccgaagcgttcggccgcaaaggtaagaataatccggggggagtagacaggacaaagaaaaggacacttccgttggagagctgagggagcgtggcagtcacatgggaataccatcgggggaaacggataaatatggtagttttgtctgtaaataagtaagcataaacaccataatgcgcattgatataatcaccgtgctgcccgaaatgatcgaaaatacactcaactgctcgatcatcgggagggcacaagaaagaggactgctggaactgaaactgcaccagcttcgcgactattccaccgataaatggaaacgtgtggacgactatccattcggtggagagcccggcatggtgatgcaaatagaaccgatcgaccggattatcaccgaactgaaaacccagagagaatacgatgaggtgatattcacctctcccgacggtgagcgtttcgaccaaccgatggccaatgaactgagtctcctatccaatttgattgttctttgtggacattataaggggatagactatcgtatcagggaacatttgatcactcgtgagatttcgatcggcgactacgtactcaccggtggagagttggccgccgccgtgatgaccgatgcgatcgcccgcctcatccccggagttctcaacgatgccggcagcgcactgtccgacacctttcaggacaatctgctggcccctccggtctatacccgaccggccgagtataaaggttggcgagtgccggatattctgctcagcggacatgaagccaatatcgccaaatggcgc

SEQ ID NO: 148 - DNA (genomic), 374 bp, PORYPHYROMONAS GINGIVALIS; double-stranded, circular
  misc_feature 1...374
  hypothetical: NO
  anti-sense: UNKNOWN
gttgaatgtanagactgaattcggccgattcttcggattcgaaacgctgacggctttctatttcgacaacgaactcatcgaaaaaagcttgctcacagcagatgaattgaagtggtacaatgactaccagcagtgggtgtacaagacgcttgctcccgaactgactaccgaggaaagagcttggctcaaagagaaaactctgactatctaaccacaaaaatggcattaatacagagtgttaggggctttacccctataatcggcgaggataccttcctcgccgaaaatgccactattgtaggcgatgtagtcatgggcaaaggctgtagtgtgtggttcaatgcccgtattgcgaggcgatgtcaattccattc

SEQ ID NO: 149 - DNA (genomic), 478 bp, PORYPHYROMONAS GINGIVALIS; double-stranded, circular
  misc_feature 1...478
  hypothetical: NO
  anti-sense: UNKNOWN
ggcaggtcgagatacgagtcggggccggccaccacatccacgtgatgttcgcggatcaactcctccttgacgcgctcggccatgcagcccaataccccgataacgagacgggaagaagcccgtcttttctttcgtagcgagtggtaatatgccagccggttcagcactttctgctcggcattgtcccgtaccgaacaggtattgaccaggatcgtatccgcctcatccacgttgtccgtgaggttgtagccgtccatctgcattacggacgctaccacctcactgtcggctacgttcatctggcagccataggtctcgatgtagagtttgcgctcttgtttattctcggcggatttagagtccgtccgatttgttcgatcatgcttgtatgttatatcaaattgtcgtattatctcgattattaccgacaaaagtttgtaaaactacttcgtgctcattatgtttgtgatggaaaagt

SEQ ID NO: 150 - DNA (genomic), 1986 bp, PORYPHYROMONAS GINGIVALIS; double-stranded, circular
  misc_feature 1...1986
  hypothetical: NO
  anti-sense: UNKNOWN
cattatcgttacttatccagtcaataatcatatattgagtgggaatatcctttattttggcagatcggatggcctgaggaaaaattttattcattacctgtttttccaaccacctgcatcggccgtcattcgaaagttgaattacatccattgtcagaaatcgttgttatttgattgaaattcttttgttaagcatttgcaaattagtcgttgggactttgtccaatgaagtgttttgtattaactctgcccggctgctcaatcttaatcgtcgatatatatctttttccatantggacgcatttatgtcaacagaagcacatagtgagttcttttgatataagtagaaatgcatcattctttcttgtctgctgggtttattcttcaacattatgtcattgatgatgattagtagaggaacatccaactcaataaattttagaacattcagattcatgcaatccattatgtttgtaaaaccttttagtggtattttgtggattacatgcccaatcgctattccagcttgcctaataagctcgatagtcatcatgaaagggaggtggtctaattcatggtcaaaacaaaatacacaatcatgcttaggaaaggcaactaagtacaaaaacttgcaattttcatctttttccccatcattattcaagtaatttcgggaacttcctttatttcagaaatcaacacataatctttgttcactttatgaacaaaagcattttcaattttcttgatgttgtgtgcatcagcatcctntgcaagtttgctgaggaagtctctttgaatactacaattttccatatttgtaatttattggtatgattgtactatgcaaaggtatgaaaatctattaaagtcaatcctctgaagcgtgaagaactttgcttttgtgcacatctatcctctaacatgcacttgtatataattgtatattagttgtttatgaatttctcgtagttgtggaaaaaaattattttttgagaagaattcttggcgatccgattctttttcgagacttttatattagtatatatgtactatattcgtttttgaaacgaaaaagcacatgcagattgaagtctttttacaaactggatgatgggatttgaggatatgaactttgagagagttttactgctcatgatgaaaggtttggttctaaatgttttacaccctcttttttggagggagggcttattcgcaatcttaaatttccggagtttgtttagttctcagacagagtacacattcaatatttttattacctttgaagcttatttagtcatcaaaaggaataatccattataactatgagtacaaaaaacacgaaagaattggtccttttagaggcgtttaagttgttttcggaaaaaccttacgacaaggttacttatacaaacctccaggagaataccggattaagcagaggcagcgtgttgcatcatacaaaatcaaagtctgctctttttgcaacagtgttaagtgagtttatactcgcaagttccattcctgagcgttcttttgaaaatggagaaagcctcaaaggttttatacaacgcttcatcgaaaattgtcgtatagagcaaaagactttgcaaaaaagaggaattgagaacataaataaatctatgctcaacttatgttctcaaactttttactactgcccaattatggcagaacgatatgcagaatggatgaaaaaccagcaaaggacttgggttaaaataattagaattgcgatggataggaaagaaataagaagtgatgttgatgtggaaatggttgcatctttatttcataatctgtatttaggattttctttctccggtagcacagaaaggggggggtacgacttaaattttcttgaaaaagagttcggcttcatttactcctttctattaaaagaataaattctaaatccggcgatcgttcaaagggagaaaagtatcaggtatatcttctgtatctctc

SEQ ID NO: 151 - DNA (genomic), 508 bp, PORYPHYROMONAS GINGIVALIS; double-stranded, circular
  misc_feature 1...508
  hypothetical: NO
  anti-sense: UNKNOWN
atccggaatctatcgaacaggccatgaaggccaaggagctgatcgacaggactacacccacgccggcccgaaagacttctacagagaaaaaaccgaatataatcgaaatcgatcttcatgccggcgaactactcgaaacgacggcagggatgaagaatggggatatattgcagtaccaactggacaaattccacgaagtcatgaaacaatacgcctcctgtaagggacaaaagattgttttcattcatggcaaaggtgaaggcatattgcggcaggcaatagaaaaagaactgcgcacccgctacaaacaacatcgttttcaggatgcctccttccgagaatatggtttcggtgctacgatggtgatcattcattgaaggatagtaccagttcctgccgaatggaaatagaaagaaaattcctggtcttaaatgacgatttcaaagccaaggctacggcggtacacaacattatacaagcttatctcgtggctgatgaacgatgcacc

SEQ ID NO: 152 - DNA (genomic), 493 bp, PORYPHYROMONAS GINGIVALIS; double-stranded, circular
  misc_feature 1...493
  hypothetical: NO
  anti-sense: UNKNOWN
gcacgtcggtcagcacctccacgggagtatgcggattgagcgtgacgcccgatttcatgccggccttgcgaatcgccgccagtgagcgatgcaggtgcggactggcttcatagtggacgttcatcatataaacgcccagttcggccaacctgtccacgaacttcatcggctccacgatcatcaggtgaacatcgagcggcttcttgcaaatcggtcggatagcctcgagaatgggaaaaccgaacgaaagattggggacgaatacgccatccatgacgtcgatatgcagccagtcggcctcgctgcgattgatcatttcgacatcgtcggccagatgcangaagtcggncgacagcaaagannggagatacgataggttgcataagtatagtatcgggtttattttttattgattcgatgctcgcaaagttatgcctttcttgcgcgatcccctgtaattttcagacgggctatcctatggtttaccaaaata

SEQ ID NO: 153 - DNA (genomic), 2943 bp, PORYPHYROMONAS GINGIVALIS; double-stranded, circular
  misc_feature 1...2943
  hypothetical: NO
  anti-sense: UNKNOWN
gccttcttatccgctcccgttgcggcattgcgcgagtcgccgccaatgggggcggagcggaagactccctctctcctaccccttcttttcgagcattctgataaaggaaaggggttcgactacagactattcacaagcaataaacttaaagtgtttgccacaggtaacagccgatacatacacaataaaccaacaatcatccaagcaatgaaacgaatcgttttatcatctttcctgttcgttctgtccatactttctttgatggcacagaacaataccctcgatgtacacatatccggtacgatcaaggatgcctcctccggcgaaccagtgccctatgccactgtaagcatccggctgacaggagcagataccacacaggtgttccgacaagtgactgacggcaacggctacttcgtcataggcctgccggcagctccctcctatcacctgacagcttcgttcgtaggtatgaaaacccataccatgcagattagtcggggaaatggacagcacgacatcaaatccatcgacatttctctcgaatccgaggacaaacaactctccaccgtcaccgtatcggcagcacgaccactggtgaagatggagatagaccgcctgtcctataatatgaaagatgaccccgcagccaagacgaacaacctgctcgaaatgctgcgcaacgttcctttggtaacggtggatggtcagggcaatatccaggtgaaaggatcttccaacttcaaaatccacctcaatggcaggccctcgaccatggtgagcagcaacccgaaggaggtctttcgctccattcctgcccatacgatcaaacgggtggaggtcatcaccgatccgggtgtaaagtacgatgcggaaggcacaagtgccatcctggacatcgtcacggaagaaggtaagaagctggaaggatattcaggttccatcacggccagtgtcagcaacaatcccacagccaacggtagtatctttctgacggcaaagtccggcaaagtcgggctgactaccaactataactactacggtggcaaaaacaagggctctcgctactttaccgaacgtactacatccatgctccaaacgatagaagaaggcaaagggcaagaaacctttggcggacacttcggcaatgccctcctctcattcgagatagattcgctcaatctctttacggtgggcggcaatgtacgcctttgggagatgaccaccgaccggaacagcgtagaaaaaagctttgccggcagcaacctcatgtcctacatagacagaaaactcaaaacacagatggatgccggatcatacgagctcaatgccgactatcagcacagcactcgcctgccgggcgaattgctcaccgtttcctaccgcttcactcacaatcctaataatagcgagaccttcattgaccaatggaagcgcgatccgctcaacacagctaatacgatccagtacgccggccagcactccaaatccgatgcgggcatggacgaacatacggcacaagtggactatacacgtcccttaggacaagcacattctttggaagcagggctgaagtacatctatcgtcatgccacgagcgatcctctctatgagatacgaccatccgaagatgctccgtggcagcccggctctctatatgcacagaatccgtcgaacggaaagttccgccacgatcaatacatcggagcagcctatgccggctacaactatcgtaaggatcagtattctttgcaaaccggcctccgagtggaaagcagcaggctgaaagcactctttcccgaaaacgcagcagcagatttctcccacaactcgttcgactgggtgccacagctcacgctcggctataccccctcgcccatgaagcagcttaagctggcctataacttccgaatccaacgtcctgcaatcggccaactgaatccctaccggctacagaccaacgattatcaagtacagtatggtaatcccgacctaaagtcggagaagcgtcaccacgtcggtctctcctataatcaatacggagccaaggtcatgcttacagcatcgctcgactacgacttctgcaacaacgccatccagaattacaccttctccgacccggccaatcccaatctgttccaccagacctatggcaatatcggacgagagcattctttcagcttgaatacctatgccatgtacacgccggccgtatgggtcaggattatgctcaacggaaatatcgatcgcacattccaaaagagcgaagcactcggcattgatgtcaattcatggtccggcatggtatactcaggcctgatgttcaccctgccgaaggattggactgtgaatctcttcggaggttattatcatgggggaagaagctaccagacgaagtatgatggcaatgtattcaacaatatcggtatagccaaacagcttttcgacaaaaaattgagagtctcgctgagcgcaaacaacattcatgcgaagtattcgacatggaagagccggaccatcggcaatggatttactatttattcggaaaatgccggtatacaacggagtgtttccctcagcctcacctacagcttcggtaagatgaatacacaagtgcgcaaggtagagcgtacgatcgtcaacgacgacctcaagcaaacctcatcccaaggacagcagggtggcggacaaggaaatcctaccggcaattgatcaagaaacactgtaaaaaaacaccatacaatgagaaaaaagattttcgccggccttgtcggtctcataggcacagcactgatagccggtgcatgcaatatcaaattcgacaacaaaggcaaaacaatcacccccaagggcgatgccatcacggagactcgcaacatcggtacattcgacaagatcgatgtcgaggatgcattcaacatccactacaaagccggtattccg

SEQ ID NO: 154 - DNA (genomic), 574 bp, PORYPHYROMONAS GINGIVALIS; double-stranded, circular
  misc_feature 1...574
  hypothetical: NO
  anti-sense: UNKNOWN
ggacaaggtggtggagaatctgagcatcttcgttgctgcagctcgtttgcgcggcgaggccttggatcatacgctgctgcatggccctccggggctgggtaagaccacgttgtcgaatatcatagccaatgagcttggcgtggggcttaagatcacttccggtcccgtcctcgacaagccgggtgatttggccggactcctcacttcgttggaatccaacgatgtacttttcatagacgaaatacaccggctgagccctgtagtggaagaatatctctactcggccatggaggactaccgtatagatataatgctggacaagggacccagcgcgcgctccattcagatcaatctctcccccttcacccttgtgggagctactacgcgcagcggtttgctgacggcaccccttcgcgcccgtttcgggatcaatcttcatctggagtattacgatgtgcatactattaccggtatcgtggagcggagtgcacgcattctggaggtgtcctgttcgcacgatgctgccgtagagatagcgggacgaagccgtggtacgcctcgtatagccaatgcc

SEQ ID NO: 155 - DNA (genomic), 765 bp, PORYPHYROMONAS GINGIVALIS; double-stranded, circular
  misc_feature 1...765
  hypothetical: NO
  anti-sense: UNKNOWN
gctcgaatgttcttgaatacttgttcggtctgctctgttactccgccgggtacaaagttccctgtggtaggatcaaggcctaattgtccggaagcatagagcatattacccatcaggatagcctggctgtatggtccgattgcggccggtgcattcttcgtgttgattacctttttcattacgtactgttttttatttggattattaatttgatgattgcagtctttgctgtcgcactacttcgtaaataacaatgccggccgcaacggagacgttcaatgagcctatagcccccatctgcggaatagctactatgccatcggccatcctaagcgtatcaggtgatggcccgacatcctccgcccccatgactatacccaaaggcagcttcatgggtacatcggtatatagatctgcagccttctccgaagcagcgactatgcgtataccgtattcttgcaggctgcggatggctccgggaatggaagtcacgcgacaaaccggaatacgatgcaaagctccggcagaggtcttgatagcatctcctcctaccgaaacgcttcctctttcgggaatgatgatggcatctacccctgcacactccgccgtacgagcaatagccccgaagttccgcacatcggtgataccatcgagtagcangaggaagggtgccttaccctcctcatagagcatcggcatgagttgatccaaacgggtatattcgatagccgaaagaatggccaccaccccttggtgattcttgga

SEQ ID NO: 156 - DNA (genomic), 556 bp, PORYPHYROMONAS GINGIVALIS; double-stranded, circular
  misc_feature 1...556
  hypothetical: NO
  anti-sense: UNKNOWN
gagtattaaaatttctcgagagagccatttttctagattccaatataataccttatatctattatactagattgggtagtacgatgaaccaattggatccccaaaaaagaatgaggcaaacagaagatttcctccgtatcgaaaagtcttggaaggaatggttcaacctagattctccagagcctaatagctatgatatgctcatgctaagaacagggaccaatatgctccatcgtaacctgctgaactttgtaagaaactcaaacttctcgatatctaccaagctcaagctgtatgctcagtacagaaaaaagggtgtattttcctggttttataacggatatagaagagatccctatgtagggtgcacttctgtgagagtcttttggaatacaataggaccgttcttatatcttattttctttgttctccattgtggaagagatctggaagaagattaagaaaataggcaattaagaatgtaaaccttatngagagtagtctatgcagcagatattattaggggggagtggangtatatccctttacttcagcg

SEQ ID NO: 157 - DNA (genomic), 460 bp, PORYPHYROMONAS GINGIVALIS; double-stranded, circular
  misc_feature 1...460
  hypothetical: NO
  anti-sense: UNKNOWN
tgttgcgttagaaaatggaaagtgcagatatggacggcttgactagggggatagctttttgtctatgtagtataagataattcctctgtattctgcgaatttatgacccttgtcttttgcctcgtatcttgctttcagccttttcaataccccttggctatagtcttcttttttgatgatttctagcaaaccttctagagcaagtttccgattctccttgagagaaaggcaattcaaattaagcgtgatatttatatcatcattccaagacttatttgcactagatattgttccgtcatgcttgtagctgatgctaagaaacagtgcgtcggtaaagagattaagtgtaatctcctcatccttcttggagcaatcgcaatgagcggagccctgactctggccactgcaacatgcaaccatattgctataggatagttgctgggcagggtatttggctacc

SEQ ID NO: 158 - DNA (genomic), 2660 bp, PORYPHYROMONAS GINGIVALIS; double-stranded, circular
  misc_feature 1...2660
  hypothetical: NO
  anti-sense: UNKNOWN
aaaggatgtaatattgtgagcccgcaaaaagaggggaatccatcagactgtaatatcccgcctctctttctttgcggaaaagggttcaaacctgatttcttaaagcattacataatgataactcctcaactaatcgaaccgtgtactattgcggtgatcggtgcgtcgcaagatgtgacaaaacccggtggaaaagtattacaaaacattctgaacggctcgtttcagggtcgtgtattgggtgtaaatccgaaagtgtctaacgtacagggagtggaatgtgtgcccgatgtgaaagatctaccccaagtagatttggctattttggctattcctgcacgtttctgcccacctacgatcgaggtgttggtgaaagaaaaagggaccaaaggaatcatcgtattctctgcagggttctccgaaatgggtgcagaaggcaaggctctcgagcggcaaatggccgaactggccaatgaagccggagctaccctgatcggccccaactgcgtcggcgtaatgaatccgctgcaccaatcggtatttaccactccggtgccggtacttacgcctaagggatgcgactttatctccggttcgggggcaactgctgtatttatcatggagtcggctctgagcaaggggctttctttctcatcggtatattcggtcggcaacgctgctcaaacgggtgtggaagatgtgctcgaacatttggacgagacattcgatgctgccacttcttctcatacactgctcctatatatagagactatctccaaaccgaaacgcttcctgaaacatgccagatcattggtacagaaaggctgtcgcattgcggccatcaaatcagggacgtcttcagacgggggacgtgctgcagcttcgcacacaggtgccatgctcaactccgatgtggctgtagatgcactcttccgcaaagccggtgtagtgcgctgctacagccgtgaagaactggctaccgtgggtgccgtacttcaacatccggtactcaccggtaagaatatggctgtgatcacacatgcaggcggtccggccgttatgctgacggatgctctctccaatggaggtatgtccgtacctccgattcccgaagaaaagactcgcacattgctgtcggagttgtttgacggttcttccgtggctaacccgatcgacattctcgctacgggaacagcagagcaattatcgaaagtgatcgatacttgcgagaaagatctggacacgatagacggtatggtcgtgattttcggtagccccggactcttcgatgtgagcgatgcttacgatgtgatacgcgaacaacagaaaaaatgcaagaagccgatctatgccgtactaccttctgtgatcaacgcgaaggaaggaatggagcgtttcattgctcagggaggcatcctctttgaagaggaagtggctttggcacgtgctatctgcaaggtctaccaaacgcccaagcccgaaatgactgaagagagcgaattgcccaaagcagcagaaatccgccgtctgctcgccggcaagagcggtatgctcggaaccggcgatatgctccagctgttggatttgaccggtatcactcgcccgcaagaacgtctggtgacaacagagacagaagctctggatgcagcacgtagtatcggtttcccattggctatgaaggtaatgggactggcgcacaaatccgatgccggaggtgtaatactgaacgtttcgaccgaagaaggcgtaaaagagagctttggcaagctgatgcaaatcaagggtgctgaaggggtacaggtgtcacagatggagagtggcgtggaagtcttcatcggggtaaagaaagagggcgaattcggtcatctgattacctgcggtttgggcggtatattcgtggaagtgatgaaagatattcgctgtgctctggctcctctcggcaaaaacgaagcactggaaatgatccgttcgctcaagtcctatccgatcattcgcggtattcgcggcaaacagggcatcaacgacgaggtaatcgccgatacgctctgtaagatctcccgtttgctggctgcagtgcccgagatcgaggagatggacatcaatccgctgatgggacgtggagaaagactatcggccgtagacgtggtagttcgtctgagcgatgcgaagtaagagatataagaaattcaagaacacagtaaaaaatatcaagagatgaattttccaatcgatgaaaaactgattcgtgaaaagcaaaacgaactgcacatcaaagacctcggcatggcttcgatccgagatctggtagctttggtgaccaatctggaaaaggctaccggcactaaattctgccgtatggaaatgggtgtgcccggacttcctgcacctcagatcggtatagagacggagatacaaaagctacgcgaaggagtagcttcgatttatcccaatttggatggtctgcccgaactcaagcaggaggcatcgcgctttgccaaactctttgtcaatatcgacataccggcacgtgcttgcgtgcctacggtaggctcgatgcagggatgcttcgtatctttcctcgtggccaatcgcacacacaaaaaccgtgaatacggtacgctcttttatcgaccccgggttcaaatctgaacaagctacag

SEQ ID NO: 159 - DNA (genomic), 1085 bp, PORYPHYROMONAS GINGIVALIS; double-stranded, circular
  misc_feature 1...1085
  hypothetical: NO
  anti-sense: UNKNOWN
gcagaaaggttggcttatcggtgggcagcaaaacgtatcaccttctgtctactcggagagcaattcattcgagatcaagatgacgctcgaaccgattcacgaactgcgcatcaacctcacagccaacagaaccgatacccgacaaacgcagacccaatacgtctatgccggcatgccacgtacttatggaggaaatttcgtgatgacgaccatcggactgaaaggcatgttcagcagttcgtccggagcgacgggctatgcctcgcaagccttcaatcagttcctccacaatcgggagataatcgcagggcgtattatggctcaatatcatggagccacttatccctcttccggattcatggaaggaagcagtctgggccggccagccggtttctctggaaaccagtgccgtttctctcaactcagccgacgtgcttattccggctttcctcagtgcttatactcagaggtcagtgggaaaaatcggcctgtccggcattcccctcatggccttccattcttcccaactggaatgtcagaaacacagccacaagcaaaacagaaaaacccaacaaataaagaaagaatgcccgaatcaaccaagcaaacagccttaccgcggtatatacaacgtagatagctatagctcttacctcggttgggtgggcttgaccgatggtagcaacctgggctttatccaagacccgtcggaccccagtacgctgactcccgttgcatccatgccattcgacattccgtttgttcgtctcgaagacagttttgctcccctgctcggtgtggaagttacgtttatgagtggattgggaatcaatacggactacagaaagactcgccgtctgaatctgaatctatcggcttatcagctcgtggagtcgaatgaagatcagataaccgtagggatgagctataaggcagagaattttgccaaactcatcggcctgcaacggacaagacccacgaggaaggcaaaaggagggcaaaagaacaacgaagaccatggcttcgcgtaccggtggggcactgactctncgagtggactatgcttacaagccgacactgacgct

SEQ ID NO: 160 - DNA (genomic), 3116 bp, PORYPHYROMONAS GINGIVALIS; double-stranded, circular
  misc_feature 1...3116
  hypothetical: NO
  anti-sense: UNKNOWN
cagcggggatgctgatgggcaacttaccaattcttgacataattccgtacctcctttatcaataaacgtaacacaatacttctcccccaactttcaactcacgagcttctttatcagtcatcactcctcgtggggtagaaacaatagcaataccaaggccgttcaatacgcggggcatatcacgataacccacatactttcgaaggccgggacgagacacacgtttcaactttctggatggcatttactttatgtgccaaatcatactttaaggcaacttttattatgccttgagagtcattctcctcgaacttatagttcaggatataccctttgtcgaaaaggatctttgtgatctctttcttaatatttgacgccggcacacttaccacacgatggccagccataattgcattacgcaaccgcgtcaaataatctgcaataggatctgtcattttgaattacaattaaattgatccggaaagccggacaatatttaaaactcttaccaactcgctttttttacgccggggataagaccggcagaagccatttcacgaaattgaatacgggaaataccaaattggcgcatatagccctttggacgcccagtcatcgagcaacgattatgcaaacgaacaggagaagcattcttagggagcaactgcaaggcttcataatttccttcagccttgagtgccgctctctttgcagcatatttcgccacaagcttggcacgcttcacctcgcgggctttcattgattctttagccatatcaattttgttttttagcgttcttgaacggtaaaccgaattctttcagaagggcataaccttcttcatcggattgcgccgaagtcacaaaggtaatattcattccgagaatcttcgtaatcgcgtcgatatttatctcggggaaaatgatttgttcattgattcccaacgtatagttacctcttccatcaagcttgctttcgatacccttaaagtcgcggattcgaggcaaagcgatgcgcaccagacgttccaagaactcatacatttgctcacgacgcagagtaaccataacaccgattggcatcttctttctcaacttaaagtttgagatgtctttcttagataccgtcggtacagctttctgtccggtaatagccgtcaattcgcttactgcaacatcgataatcttcttgtcaccggtagccataccaagaccttggttgatcacgattttcttcaacacagggacttgcatcacgctcgtataaccgaattgtttcatcagggcaggaacgattctttcctgatagtctttcttcagattggcagtggcactcattatttaatctcctctcctgattttttagcgtaacgaactaatttgccattctcattgagacgacggccaatgcgagttgcctttcctgttttgggatcgacaacattcaggttggaaatatgtataggagcttcctttgatatgattccaccctgaggattcttggcgctaggcttagcatgctttttgatcatattcagcccttcaacgatagcacgctgttcctttactaatacctccaaaacgcgaccggagtggcccttgtcttcgccactgatcaccatgacggtatcacctttctttatatgtaatttactcatttctgcttgcttaattataaagttataatacttcgggagcgagagaaacaattttcatatttgttccacgcagttcgcgtgcgaccggtccgaagatacggctgccacgaatatcaccggctgcattcagcaagacacaagcattgtcgtcaaaacggatatacgatccatcgggacgacgaacttctttcttcgtacgtacgattacagctttggagacagcacctttcttgatatcgcttgaagggataacactcttgaccgaaaccacgatgatatcacccacagaggcataacgtctgcgcgtgccgcccaaaacacgaatacagagagcttcttttgctccgctgttgtcagcgacaacgagtcttgattcttgttgtatcatcttattttgccctttcgattatttcagttagtctccatctctttgtacgactcagaggacgcgtctccatgatacgtaccgtatcaccgataccgcattcattcttctcgtcatgtgcgtggtatttttttgtcttattgacaaacttaccatatataggatgcttctctttccacttcacagcaaccgtgatagtcttatccattttgttgcttgagacaacacccacacgttcttttctaagatttctttccatgtgtgcactctatttatttattgagttcgcgttggcgcagcactgtcttcatctgcgcaatcatacgacgttgatgctttagtttagcaggactatccaaaggcgaaaccgcatggttgattcgcatttggtcataagcagccacttcggcatccaatcgctcctggagctcttttgttgcaagctctttaatttcggcaatcttcatgacaattacgcattttgattttggatatcataatcgtgacgaaccacgaacttagtcgttacggggagcttctgagcagccaaacgaagagcttccttagctatttcgtaaggcacaccttccacttcgaaaatgattcgaccgggagtaataggagcaacgaaaccttccggagcacccttacctttacccatacggacaccttctcccttcttggtaataggcttgtcagggaaaatacgaacccatacttgtccttgacgctgcatatagcgagtcactgcaatacgagcggcctcaatctgacgaccggttatccacttgctctgcaaagacttgattccaaaagaaccgaaagacaactggttacctctctgggcaaaacccttcatgcgacctttctgctgtcttctaaactttgttttttttggttgtaacattttgtctgtctttctaaatgttagcgattaccttttcttctacggttgcgatcaccgccacggttgttgccgccctgtgcattgggacgacggctttggtttttggccactgcaaaattgggggcgaggtcgcgtttctcgtaaacctcccctttgcaaatccaaac

SEQ ID NO: 161 - DNA (genomic), 532 bp, PORYPHYROMONAS GINGIVALIS; double-stranded, circular
  misc_feature 1...532
  hypothetical: NO
  anti-sense: UNKNOWN
ggcgtgaagtacagcgatattaaccaactcggcaacgaagcagagcgcgctgccctcaaagagagctatagccacctggctaagctgcgcgacgaagtgatcgccatgggcatcattcccgcgatcgctgactggaagacggtgaatccgaacctctaacagcagttcttcgcaaataatactcttgagagagggggagcatccgaatgataagttttcggtgttccttctctttcttatttcccgtcccttttgctttttgtgtttatccgccacatttgtcagccggtagagatgacacgatttcggcagcatgtaaacgggcaaaaagagaaaagtcgtatcctcccttcgcattcggacataaagaaaaagccgaaaccctcttgcatcgaagaaggtttcggcttttcggccggaggcaaacgactatcaaagactattccaggaaggagcaaactatctccataagtccgtgtccactgncctattgagaaaggcttactcgtcaggcgtgccgaatttcggccgg

SEQ ID NO: 162 - DNA (genomic), 439 bp, PORYPHYROMONAS GINGIVALIS; double-stranded, circular
  misc_feature 1...439
  hypothetical: NO
  anti-sense: UNKNOWN
gctttcatcttcatggctttccatgtagagatggccggagctgcgatcatagcaatgacagcaggacgcaatcctcggaaaatggctgcaatgattttgttgtccctcatctgcgcaaagaacatggctacagccagaatgatcaggaacgagggaagaatagtccccaaggcgcaaacggctgctccggcatatcctctgaggcgatagcctacgaagatggatatattgacggcaaatactccgggcagggattgcgcaacggcaaaaagatccagaaaatcctcctccgatagccagtggtggttatccactatatcggccttgatcagtggcaacatggcataaccttcacccgaaggtgaatcccgccgataccggaaaaaggtgagaaagaagggatagatatggatttcacggcaaaaaaagaagaccactt

SEQ ID NO: 163 - DNA (genomic), 628 bp, PORYPHYROMONAS GINGIVALIS; double-stranded, circular
  misc_feature 1...628
  hypothetical: NO
  anti-sense: UNKNOWN
gcccgaaatacggaaaatcaaacaaaatgtttcactaacaaaaaagataaacgaacatgaaaagattattactctctgctgctatcctaagtagtatggctttgtttaatgtcaatgcacaagagttgaaaacctctgctgacatgaaaggttcttttaagaagaatgtggtattggaggtatttactgccgaatggtgcggttactgtccaggtggaaaagagcgcattgcaaaagcaattgaaatgttggatgatgaatataaggagcgtgtttttcagacatttgttcattataatgatgggatctcaaaaaaatggcctcgtgttggccaacttttcattgcattggatcaaacattgggcattccgggttttccgactttttcagtttgccgtatggagaaaaaaggtgaaaatctttcaataggtgctccaatagcaattaaaaataagattatgaaaggttttggtgatggtacagcccctgcagaggtaaaccttaaattgaccaaaggtgcaacaccggaagatgtatgtacagctacatttactggtaaagtcgatgctgacctcatagggaaacctcttatgttgactgcatatgtattgaaaaacaatatgaagcc

SEQ ID NO: 164 - DNA (genomic), 780 bp, PORYPHYROMONAS GINGIVALIS; double-stranded, circular
  misc_feature 1...780
  hypothetical: NO
  anti-sense: UNKNOWN
ggcttttttcgcaatttttgcgatggcttgtgcatgccagggagggacggccggcaagtcgttcaccaactctacaggatctccgggcgaaatgatgctggtcatggacgaccaatatctgggatcgcctgtcggcgaagccatctacgaggcaatgaccgaggtggctccggctctgaaccaaaacgagccgatcatggctgtttcgcgcgtatcggaaaaggattttacgggcttcctccgctatatccgcaatgtgctgcagatcgacatcaaccccgatatattcaccaagacttctctcaaatacggctatgaccagtgggctaacggtcagctcgtcgtgctgatcaacagtcctgcgacagattcactgacggcctacgtcgaatccaacaaatcggccatacagaacctctttatccgccacgagcttttcctcttcggccagctttggcagaaagactgcagtgcggatgccgaccagcgcgtacagcgtatgttcggataccatatcaatgtgccggccgatatactcagccacaaggagggcaaagacttcctgtggatgtccaacaatcagatgcgccggcgcaaggattttttggtatatactttcccctatcgcggagcatcggatctgggactcgatcgtatggtggaggtgcgtgactccgtgctcaaagccaatatagaaggttcggacgcagggtcttatcccgtcacggagcgtatgctactgaagcatcgttacgtctacccgggcgaccaaaagcaggc

SEQ ID NO: 165 - DNA (genomic), 692 bp, PORYPHYROMONAS GINGIVALIS; double-stranded, circular
  misc_feature 1...692
  hypothetical: NO
  anti-sense: UNKNOWN
gggaatgggtcttccattgactatgatttgatgaaattaaaatccggccaaccaatcggtaatgccgaaaaaatcagctccacaaaggtaagattatcacgcaaacgaaaaagatgctttgcattcagagaccattgtttttgctctgaagctatcggcaaatgtactcatcctgcaaaaaagaagagggcgacccaagaatatttggatcgccctctgttctttatgctaacttcattcagagggctgtcggctcctcctgaaaaaagtgttgtcagatcatataactttattttttgtcatccaggctcgcactgatgaaattgccctgtgcatcgaacagcaaatcatactccttgttgttgtacacgatttccgccttgtatgtgccgttggactttctttcgatgtccttgataaatgcaccggggtagttccggttgacgtaattgatgatcttagccttgatgtgagcaggaatgttgtcgtcatcatcctgatcgtctacgtttccgctgatgaggttgccctgtgcatcgaacagcaagtcgtactccctattggtgtagtaaatttctacgtcataagtaccattggagttacgctcgatactgtgaatgacagcttcccggtaattctgatgacatagctgatgatcagagcctgatgttggcccgaatgtgtttcgatgc

SEQ ID NO: 166 - DNA (genomic), 504 bp, PORYPHYROMONAS GINGIVALIS; double-stranded, circular
  misc_feature 1...504
  hypothetical: NO
  anti-sense: UNKNOWN
ggctggagaataacaagaaataaaaagacgatgaatcaattgaccttcatcagaaaaacgaaccttaacgaccaatcaagtataaaagcgacaaaagctcccccggtctccttcttcgtcaatgaatcgaagttatagtcgagcgaagctcattgaacaatgtttcgggcggaaagattatctttgctcccattcttatagacactctgtttagcgaagttaaaatttatgagtcgcagatttgccgaatacgagagcttggatttgtcccgtgtcaatgaggaggtgttggccgattggatgcaacaccgtctttttgaagaaagtctgaaaagtcgcgagggtgccccctcgttcgttttttatgagggacctccctctgccaacgggatgcccggcatccaccacgtaatggcttcgtgccatcaaggacactatttgtcgttacaagacgatgaagggttttccgagtggaccaggaaagcccggctgggatactcacgg

SEQ ID NO: 167 - DNA (genomic), 3247 bp, PORYPHYROMONAS GINGIVALIS; double-stranded, circular
  misc_feature 1...3247
  hypothetical: NO
  anti-sense: UNKNOWN
caataggtgagcaaaaaagataccttcttgataatcttctctttttgcaaaggtttctataattctattggagaaggtgcaatctgtagagcagggagagcgaggcgggggctaaaggttcagtcctccgggaagtttgtgcgtcaggaagacggtatcaccatcagtggagtactgccaggattctttcatgacgaagcgtattgctttgagcacgacgtcgggatggtgatgcagttctcggcagatatccgcaatcagtacgtagggtgtttcttcggtcaaacgttgctcgaggaaatgtagcaagtcgtccacttcatgatggtgcagttctccgtcttttctccttagacatacgtcgcatagcttgcagttgtgggactgctcctcgccgaagtaggccagaagcatgcggctgcgacaggtgttttcttcctctatgtagcggagcgactgatcgattcgtgctttaagccgatcgcgacggtcctcgtaagccgcacgaggtatctggagcaattctgcatcctcacgtcttgtgagaaaataaattcgtggcagattcttttgtggaatatagttcactatgccggctttgttcagaagcaggagttgctgatagacctgatcgacgctaagccctgtcttttcggccaattcgctttccactatggaaacataatccgcaaacaacccgtcgtatgtcctcatcagggcagtcagcacgctgtcggaagcctgttcgcttctcatgcggtatagctcgtcgcgctgcacctgtattgtcaggcgcgagcgcgtcttttcctcccgatactcccaaatcccggctacatcgaggatgcgaatcgcagccaatacttgtgttgggaacatcctgaaattccggcaaaaagcatcgatgtcgaagtcgaaagatcgctcgaatccctctccttctcctatctgcaggtagttgcaaatccgattgtacaccgtggcgatgtattcacgtggaggaaactcattgctcactcgccttttcaggttgaatatgtcgtcctcccctgccagtaagacggcataagccctctctccgtcccgaccggcgcgaccggcctcttggaaatactcctccggcgaagagggcatttccatgtgaagtaccaatcggacatcgggcttgtcgatccccatcccgaaagcattggtgcagacgatgatccgcgtttccccttccatccagcttttttgccgtatttcccgtgtcacatggttgagaccggcgtgatagaaatcggccgagaagccgttttcgccgaggaagcgtgccagatcgcgcgccttatctcggttgcgacagtatacgacggccgaaccgtccacgcgactgaggatatgcagcagcatcgtctctttgtctgccgtccggcggatggaatacgacagattggggcggaaaaagctttttctcagcacgttcggctccggaaatcggaggatgcgttgtatgtcgtcgatcaccggccgtgtagccgtagcagtcaatgccaatacgggaacatccggcagggcctccctgatgtctgctatcgagaggtatgccggccggaagtcatagccccactgggatatacagtgacattcgtctacgaccagcagacttaccctgagagcatgcagacggctgaggaaaagttccgagcccagacgttcgggcgaaacgtatagaaatttgtagcggccgtaaatacagttgtccagcgtggtgataatctgctcgcgcgtcattccggcatgaacggctgtcgccttgatccccttttggcgcaatcccatgatctggtcccgcatcagagcaatcagtggcgttaccacgagagtcaaacccggcagtagcagcccggggacttggaacgtgatactcttaccaccacccgtgggcagtagtcccaatgtgtccttccctgccaaaacggattcgatgatcgggagctgcacaggcctgaacgaagggtagccccaatagtgtagcaaaacctcctccggcgtatgcagagacggagcttcgatctcattggaaacctcctccggcataggaggaagaaagtcttcttcctctctcccgatctcatcactctgctcatggtcgtacacttccccgtgcaaataacgatcgggaacctctttcatatcggtggagaggggatagagacgttcacccggtgacaagtgttgcagctcttcgctcatctttgttctcgttctgtattctatatgattctctgcattccaaattcagacagcctgtggactaaccccggataataatccggtgcagcgtgtgaaaatcatacacgaaagtacgaataatacgcccaaccgtctgtctcgaacctcagccgatctccgacaattccggaaccgcaaaagctgcgattgcggttcgtgtttttgggaaaagtgacgcgagatttttttcgttgtggcgcgtaaatttttcttttctcgcaccaaaaggaaaacttttacgcgccgcatttttagggccggtgagtcgccgttttttggctcgtgaaaaggtggcgatccccagccggttcttcttcggctatttcttttcccatcttgtcggatcttttggcttaatcctctcataatcaggtgctcatccttgagtggtttgtctctcgattcgcactttggtctcctccgtttaggtctggttttgggagcttgtttatggtagcctttgcagtgcgattcttgaggtatttggtctttttatacttatctaagagggctttacgtacttcttccttatcttgccgatgagttttttttgtacctttgcaagaaacgtagatgacggtaaaagaatggattccaaaaaaattctttacatatcccaagaaattttcccctacttgccggaaacggacatatcggtcgtttcgcgcaaattgcctcagaccattcaggagcgaggcaacgaggtgcgcatttttatgccccgctatggcatcatcaatgagcgtcgcaatcagttgcacgaggtgatacgcctttccggcatcaatatgatcattaacgacaacgaccatccgttgatcatcaaagtggcttccatccagtcggcccgcatgcaggtttatttcatcgacaatgatgatttcttcaagcgcaagacgatgtacgacatcaagcccaagcaggagaatgacaacgatgagcgagccatcttttttgtgcgcggagcactcga

SEQ ID NO: 168 - DNA (genomic), 6464 bp, PORYPHYROMONAS GINGIVALIS; double-stranded, circular
  misc_feature 1...6464
  hypothetical: NO
  anti-sense: UNKNOWN
ggcgaatcggtttcataacaatgagaccgttgcacaaaaacccttccaccccctcatatcaatcaagacagatacaagcattgatttgacgaagaaaggagagcttcatgcggtctctctgcaaacctcaagaataccccgatggaaacttgggaaaatttctgtttgtttggtgcccatatgtttgaggtttgatctttcctgaaaaacacttaagaatcagctctgcggcaaaagacttcaatgaaagtcctataaaatagttgcaaacagctgatagttagcgcattgatgggagcataatcagctgacaatcgtttcttatttctcgcctatttgacgaggaaaggagtacttctctaatggaaacttggggaaatttctatttgctcggtgcccatataccgaaggtttgacctttcccgaagacactaagaatctgctctgcagcaaaagaactcaatgaaaatcccctgcaacagtctcaacagtgcaagagtcgaaataactaaatatgttgtgttatgaaaagggagctatatcagaatccgaaaaaatggcgaaaatcaatttgttgttgaagcaaaacttgtaagttgcactttaataactaagcattgccattaaccaatttatgctttaatctttatttcgtctgaatatcttacctttggtgaaattcttttacgaagctatgcttgtaaatagaaacctgaaatcaatagacgcataaaatcataattacaatcataatttttgctcatctctatgaaaagaaaattcggttttctctgtgctgtgctgctggggatcgctgtggcgactcctaaggcagaggcttgcaccaatctgatcgtagccaaaggggcttcgactgacggttcggtaatcatcagctattcggcagattcgcatacgctctatggggagttgtatcactgggctgctcgtgattgggctgaaggaacaatgcgcccaattatcgaatgggacacgaacaaaccacttggattcattcccgaagtagcgcatacctacaatgtcatcggtaatgtgaacgaacaccaagtggctattgccgagacgacatggggcggacgtcccgaattggccgaaagtgatggtatcatggactatggcagcctgatctatgtggctctccagcgttctaagacagctcgtgaggctatagacgtcataaccaatctggtaaaggaatacggctaccatagcagtggcgaaagttttagtgttgccgataagaacgaagtttggattctggagatgatcggcaagggtaaggggcgcaaaggtgctgtgtgggcagctgtgcgcattccggacaatgctattagtgcacatgccaatcaagctcgcatccagcagatcgatttcaagagtaaagattatctctattctcccgatgtcgtttcatttgcccgtgagatgggattcttccaaggaacagacaaggattttagcttccaagaagcatataacccttataccgaaggtggtcttcgtggttgtgaagctcgtgtatgggctttcttcaataagttcaattcgcatatgggtaagtatgaagcttttatacggaatcagagcaaggataaaatgcctctctatattgttccggatcgcaagctctctgtcgctgatgttcgcgatatgatgcgtgatcactacgaaggtacttccctatgtatgacgaacgatccgggtgccggcccttataaagtaccctaccgttggcgtccgatgagcttcgaagtggatggcaaggagtacgttaatgaacgtgccattgccactcagcaaaccggatttgttttcgtagcccagttgcgtaattggctccccgatgccattggcggtgttaattggtttggcgtggacgatgccgatatggccgttatgagtccgatctattgttccacaacgcgtgtgccggagtgcttccgtcagggtaatggcgatatgatgcacttttcttggacttcggctttctggatccacaattgggtggctaatatggcatatcaccgctatgatcagatgatagccgatattcgccctgtacagcgtgaactcgaaggagcttgtgaccgcatacttccgactatcgacaagcaagcacaagagctatacgctctggatccggccaaagctgtagcattcctgacaaattacagcaacgaagaggcagagaaagcaactgcccgttggaagcgtcttggggaatatctgatggtaaagtacatggatggcaatcgcaagaaagaggagagtggccgattcaagacaaatggatacggtttcagtgccatgcctgatttccccggttatagtcaggaatactatcgacagatagcaacatctgaagcggccgaacgcttgctcaagaaagaaaaggaacaacattaagttggtttattccctatctttgtccccgaaataaaaagagacaagaccgatcaaggtcggtcttgttctttcggctctgtagttcaatggatagaatagtggtttcctaaaccatagattcgggttcgattcccgacggagctaccaacctgaaaaacactgaaatcaatacctttcgctcatactactgatgccgtagaggcgtcatgtacgcatcttttcagatctatgggtcgaaataaattcggattcggaataccttccgagttctttttttctaaatatgccttagtgttgcatttatttgtggagtgtacacatagaaaaacgaaacttcagaaaacccttcgaagttcccatcctaaatttatctaaccgttgcacttgagactggaatgtgcacaacgccctgatcgggaggccaaataggcatctgctaatgtcaaccaggtcatggcttctaccaccggtacggcacgtggcaccacacaaggatcatgccttcccacagctgagagggatatgctttctccctgttcgttgacagtctgctgtttttgcccaatggtaggagtcggtttgaatgctacgcggaaacgaatatcctgaccggtgctgatacctccgctaataccccctgaatgattggaaagaaacgagatgccaccatcttctgcagcgaccatctgatcatttgcttcggagccacgcatggatgccagggcaaatccgtccccaacttcaaaacccttggctgcattgatgcttagcatggctgcaccaagagcagcatgcagtttgccataaagaggttcaccccaaccaaccggaacgtcacttatttggcaatcgactataccccccacgctgtcagattctttctttgccgtttctattacagcttccattaatccggaagcattaggatcagggcagcgaatgggggaagactctacttcttcagggctatattctttggcattttcttggggtatacatacagggccaatctgtgacgtataggctgtacatcggattcccaatggagccaggagttgcttggcaacagctcctgccactacgcggacagccgtttcgcgggcagaagaacgtcccccaccacgagtatcacggataccatatttatggaaaaaaggaaaagccgcaaggccccgaacaaaaaagaaccgaagactgtcggtagtcagcagaacgtacatctttattgtctatcatgaaagcaataggagcaccggtggtttctccccgaaataggccggagataaactgtaccatgtcactctcctgccggggagaagtataatgtgactgccctgggcgacgacgaagtaactctcgctcgatggtttccatgtctacaaaaagccctgccggacagccgtcgatgacacctccgatagctttgccgtgggattctccgaatgtagtcagccggaataacttacctattgtattcatctgatttataatagctgtgtttgtgacattctcaacttcagacagagtttctgacaaagagcagatactgagaaattaaaaagctccaagccattgctttttagagacaacggtttggagcttttctccgttttattgctttgtcccgatcagtgacagccacagtcgctgccacagttgcaaccatctgatgattcactttcgcagctacaaccgcaaccacagccggagtggcctccaaagaactgttcgatctcttctgccgtcgcttcacgctcttcgatgatctctccgatgaaatgaagattctcaccggccaaaggatgattgaagtccattaccactacatcgtctcgtacttccagtacagaaccttgcaaggtattaccttcggcatcgcgcatcggcacggtattgccttcgtagacgatggaagagtcgaatcggccttcttcgtctttgaagatatccttgggcaactccaatacggcatcttcctgacgttcgccataggcatcttcgctcttaagctcgaagtcgaatttgtcacccacagccagcccgaacaaatgcttttcgaactcgggcaacatcatacccataccatgtatatagcacaacggcctttcggccgtggcctgctccatcaattctttctcctctgccaaccctacatacaagtcgtagctacaggtcacaaatttatttgctgaaatactcattttaccaaaattatcatgttaaacgctaccaaaagtagtataaaaagggattagtcataactgctcttaagaaacagacgggcaaatttccgctctgcaactttcagagccatcacttttcgcatcggcagcactcgtttgaatttatagtagtactctttttccaaccgtgcctctgcaattttattgtccaaactcttattgatgatcagctccatgtcggcatccgtcaattcggcttttcgttccatcagagcacgcttttgccgaacgtctttccacagctcgtagcgtttggtgtccagctcgttgtacagcggaagaaaagcatcggtctcctcctgcgtcagctccagttcaaggatgaagaaagcattgcgttggttcatgaactccctcttccgaccttgttgttcagactcctgaaatttggtcgctacagaatagggaggcatcgctgcctgcgagagagttggcagcagagcagccaatataatagtaagagaaaagattcgcttcataccgcttagatggtggtgcgagtgtcgctcgatcattcgctgaaatccgttagtacccattcgtctgacactgtttcagcacagttgtcatggaggaaatctctataatcggtgtcctcgctccatctggtgtcgccatggtctaaagcaacaagtccggctgatgtggaggtggttctaccggtatcactccccactccgaaaaggctgaaggccttgaacataccgatcatcagcaggaatgatgccgccaaataaagcaacgggcgcaatttaggccacaatgctaccgaaggcacaaccacagtattttcctctttaacggcaggaatctgggccatgagtttgtccgtaaaagaggcgaagtagtcatccggcacagagtagtgtcgaatactgtcctctttcggacggatattcacatcggggtcgaactgtttcatgtgagctttgttagttacgattatagaggcttgttcttagggcaagtttaatcatcgggcgacaaaaaacgctccaacttcttcacagcatggtggtacgatgccttgagagcaccttccgaggtaccggtgatttcggccattttttcgtaaggcatctcatcgtagtaccgaaggttgaacaccaaccgctgtttatcaggcaattccagtatagccttttggaaggtaatctcggcttcatctccatcgaaataaacatcccccgtgaggttgtcgagcagataggagttttcgtccgtgatcgatatactcatatcgtcttcgatctttttcttcttcaggaaattgagtgattcgtacatggctatccgatagagccaggtggagagtttggcctccccacgaaaaccgtccaatgcactccatgccttcataaaggtattttggagcaagtcgtccgtatcgtcatgactgagcaccattcggcggatttgccagtagagtttacggttgtacaggcgtactaccttttcaaaggccatacgccgccttgccggatctctcagctcttccagcaactcttcttccgaaatcaatagcttatcagccataatgatgcggtaaagatagcaaaagagtgctttatctatgtcaataaagtcgaagattcagctctgatcctgtagcgagagaccgaaacatgagagagttatgctcctgtgctttccattctatggccgactctatcctttcggctcatgcggcaatccaaattcaaatcctttgcagttgcgctactcagacaaggtattgcaaatgcctctcggctattacccaaaatacgtgcgaaaaaagttttcaacaactaa

SEQ ID NO: 169 - DNA (genomic), 699 bp, PORYPHYROMONAS GINGIVALIS; double-stranded, circular
  misc_feature 1...699
  hypothetical: NO
  anti-sense: UNKNOWN
gttcgaaaagcgttttaattcctgtatggtgcaattgaaatatgatagaggagataggactcgcgctcaccgatacgttttaattcctgtatggtgcaattgaaatctcccgggttgggcagcacggctttgaggaattgggttttaattcctgtatggtgcaattgaaatccgttacaaatataggcttttctgtttgaatgtgaggagtttacgaaaaggtgaaacccaaaattcagacattcatagttgtcgatgtctgattctatgaaaaaccaaggggtgtgacgactgatatattttattgattatcaatcatttcaaagatcgccggaggttaatcatggcaaaaggcttgatgaatttgctcgagccgacgcttcaaaagatagatagcgggagctgtatcgtgctgtattatagaaatatatccgttgcagaacgctctttgccaattatttctttttccaaccaacgttcttgtctggaagaaaatatgatcagactatcttcttctttttccataattccggctgctctgctcttcagctctaagagcttgacttccgatatttccccctcgaacacagagttctgaatccaattcagatattttctgcacagttttaacattttgccaacacgcttttcaccgatatcgtacactaaaataatatacattacccaatacatcttaaa

SEQ ID NO: 170 - DNA (genomic), 683 bp, PORYPHYROMONAS GINGIVALIS; double-stranded, circular
  misc_feature 1...683
  hypothetical: NO
  anti-sense: UNKNOWN
ggcgagctttttcacgcaattggatcangctcttttactctttccagttgaaaactcatattcttttctaaatagttaggtttgctatttcatgacatacaggcatactcgccggaaagcagtcggcactgtccggtcgcccgtagggtcgttactattatttatgatcacatacctcggtcagcacacccatagtactcttcgggtgcaagaaaccgatattcaagccctctgctcctttgcgagctttttcgtcgatcagcttaatgcctttagaggcggcatcggccaatgcttcgttggcatcttccacacaaaaagcaatgtgatggataccttctccacgcttttctatgaatttggcaatagggctttcgtcagaggtcggctccaacaattccagcttggtctgccctaccatcataaatgcggtacgcaccttttggtcgggtacttcctcaatgctgtaacacttgagtcccaatacattttcgtagtatgggagggcttcttcgatacttttgaccgcaataccgagatgttcgatgtgagataaattcattgctctctacttttttattgtgttgactcttctaccattgtccgaagatcttaatgcaaagcattttcgcaaatgtagaaattattcttgatggactgattaagtattgnccatataatcc

SEQ ID NO: 171 - DNA (genomic), 415 bp, PORYPHYROMONAS GINGIVALIS; double-stranded, circular
  misc_feature 1...415
  hypothetical: NO
  anti-sense: UNKNOWN
caaagagaaaaggcgtgtagatggtatgcctggcacacgatctacacgcccccggagttattcgcttctgagatcgtcgagtacttcgtcgtacttgtcaccgatctcttccaccatatcttcggtgattcccttcattttcctacggtacttctggtagcgattcttggcttcataatagccttccaccacgctatcctttactttgtcggctgtactgttgatgtcttcaacgaagcgagtacgcttttcacgatcagcgaaataagcagcggtagcccnaatagcaaggcccactaacagaccgagagaaaactttccttgtgagctcataaaaaatcctccttactttattaaatgctttgaatcaattttgtcagaaaaccaattcacncgaatgatgaatcgtttcgtt

SEQ ID NO: 172 - DNA (genomic), 678 bp, PORYPHYROMONAS GINGIVALIS; double-stranded, circular
  misc_feature 1...678
  hypothetical: NO
  anti-sense: UNKNOWN
agcagattatgccatcacggcctctcactcggagggtttcggtctgaattatctggaggctactgcttgtggaaaacccgttgtagccactgatttgcctccattcagagaaatctgcggcacaggctttcaggacaacgaattgtttttttctgtaggaaaccaaaaagaattggaggattgcatactaaaaagccttggtcatacgttcaaccctcaaaaagtctccgatatcaggcatcatttctctgcggaaacaatgtctgtacaatatcagaactattatacggagctatcagctccactaaaatgaattcaatgaagagtgcatgttccgattattactgcttcaatcgtactttataaaagcaaaccggatattattcgggatgtcattacctcctttttctctgatacggtaactaagaagaagcttatcctcatagacaattctccgactgacagtcttcgtgtcctccaagaagaaagaccggaggatattcaggtatttctttaataaccgcaatataggattcggatcagctcacaatatcggtattagagaggcagctcgcttcaatccttcttatcattaattcttaatcctgatgtgcagtttggccctgaagtggtgccgacattggcttcatacatggaccgagaatcctgatataggat

SEQ ID NO: 173 - DNA (genomic), 7012 bp, PORYPHYROMONAS GINGIVALIS; double-stranded, circular
  misc_feature 1...7012
  hypothetical: NO
  anti-sense: UNKNOWN
gggtaacgacagcattcttcaccggatcgatcatttgggcaatagcctgattgaatgcttccagaggaacctgaggagcaaaagcattcaccgtctgatattccacctcaatacccgggatatagccgccatcggtgaagtaggtggagtattcattggcataagcattgttcttacgcttgtctctttcgttgtattgattctcgtatcgcttgagcacattcgngccgtgcacgatccgtattcgcctttggtgaataccgaactgacggaggctttctatctctgccaccaatgcgttcatcgctttctccgcttcaccctcacgaaccgaggcaacaaaattgaatgcgtccttagtctgggtgatgtacatgaagttagagaagaaagctcctgcactgaggaaaggagcgttaggcttgtgagtaatctcggacagacgctcattcacggctgtagtgatcacctgtttcatatagtcttccacaagtccgaatatcgatcctcgcacttcttgaggagtggggtcgctcttgaagctgatggagagctgcgtggtagtagcctcagcatcggtagcaatggctacgataggctcatcgttgtcctctaccggcgtatagatacgctctgctggattcacgggagcaggaacgtccttgaagagttctttgatcttgttctccacatagtccacatcgatatctcccacgatcaccagaccttgcaggtcgggacgataccatttcttataatagttgcgcagctcatcatgcttgaagttgagcacgacgtccatcagaccgatgggcatgcgttctgcatatttattacccggcatagccttggcaagtatagcctcgaacatacgaaggttggcatcgcgacgagcacgccactcttcctggatcacaccgcgctcctcgtcgatctcatgcccgtcgagggtaatattgttactccaatcatgcaggataagcaagcaggagtcgatgattccctgacgtgtagtcggcacatccattatcgtatattccgtcttgtcgaatccggtagaagcgttcaggttctgaccgaaacgtacaccgatcgtttcgagatagttgatcaagttcttaccggggaagttcttcgtaccgttgaaagccatgtgttccaagaagtgagccaaaccggactggctatcttcttcaagaatagaacctaccttttgtgcgataaagaaatccgcacgatctttcgggttctcgttgtgacggatgaaataagtcaatccgttgtccaacttaccgacacgaacagccggatctgtagggagtggctgagcctgttgggcagaaagcttcatcggaatgaatcccacaagcagaagaccaagtgataaaaatcttttcaattccataagtatcttaggttacttgtttggttattaagtaatttcggccaaaagtacggttttttcatcggattagcacttttcaatccggctgtatgtccggaaaaaccgtgagagtcccactttacaggaccggtctctatacttggttcgaaaaaacaaaatgacgcacacgcttttcgcagggaataacagagcaaaaaagaggcacgactctcccgagcggtgcctccttcaaaaacatgagatcagataattacttcgtttctatatgaatgtgatcctcagtaattcgttttcattggctcgaagtaagcctgcggatgagcgcaagcgggacatagcttcggagctttcttggaagtaatgacatagccgcaattgcgacattgccatgcgatttcttccgttcgctcgaagaccgatccatcttccacatgagccaaaagagccagatagcgacgttcatgctcggcttccacctttgctatctgacgaaatacggctgcaatctccttaaatccctcttcttcggctgtttcagcaaaagccggatagagatctgtccactcttcattttcaccggcagccgccgcgcgcaagttctcagccgtggaaccgattattcctgcaggaaaagaagccgttatctcaagcatgccgccttccaagaaagagaaaaaccttttggcatgctctttttcctgctcagcggtttccatgaaaactccggcaatttgttcataaccctctttcttggcaacacttgcaaagaaagtatagcgcgaccgagcttgcgattctccggcaaatgccatgagcaaatgcttttctgtctttgagcctttaatactcttattcatttctgttttctttttaatcgacatgacgagagtccgactctcatcacaaaaataggtactaccactcaataaaacaagaaaaacaaggataaatatacctacagataggtactcgtatctttttgaagccaaaagagagatagataaacatgcaataagactgaaaaaggaacacaaagagtccacctcatctattaagaagacgtcagttcgatctaagcggaaataggaaagttagggtttctgatgatttcaatattgagttcaggctttttaggcaggatgttgtaagcgatgataccggagatcaggttggtgacaaaattgttggcactgcgatgtctcgtgtgctctatctgacagacatttttgagcatatcattgaccgtttcgaacagggctctctttctcaataaaactttgtcatatagatgcatcagggagttcttcatgttctttttgattttggttatcatgtggatgtcatcgacaaagagccggtcaaaaaggttttgggaaatgtagcctctatcggcaatgagtttgccaaaaagattcttggtgaatgttccgtctttcagaggttctctgtcatcacaattgcccggtgtgatttgatagttgatgatttcacccctgtcgttgataacaatatgcagtttgaatccataaaaccaacccatggtgcttttgcctttttgagcccatcccctcattgtcctatgcccatgagctcgtttgatatgacaagccttcagtggggtggaatcgatgaaagagatgcctgtacattgacccaaacaacacatattgagaaatgctatcagcttgaaacccaccctgctttgcagctccacaaagcgattataagagacaagatgtgggaactcggatcgacaagaataggtgatgtattgaagataaaaagctttcaaatctcggtatcttgacagatgaaacaggatcaggatggtcatgacctcactgtccgacatcttaaactttctattcctgcgttttttgtctgcctcttcgagggtctttttcttgattgcttcatcaaaaagcttggagaaatcatctatgatgcaaaaaacatcaactatatttgtcttcataaagtagcgttttgttcgttcgtatcttattgattatcaactgctaagatacaaataattcgctactttttcaagcataatgcccacgttctttgggcgtttaaccctaatcaaaaaacaaattcattggtgttttcttacgtcgaactgacgttctacggaataccgctatgctccttgtggtatagttagtcgtcagttcgatccagacccaacttccctatttgcgcttagatcgaactggcatctctgatcttaatgcggtaaaatctgccacttcgataaattacgaaccgaaaaagctcggattgtggtctgtaaatccagagaaaacggcgcgagaattttttcgctttggcgcgtaaaatttttacctcccgaaccaaaacgtaaaaaatcacacgccactctttcatggctgtaaagccggcaatttttggagcctaaaccatcgcggggagagggagtagcgatgtgtactttctcggacttccgagtacagattcaggcactgtattgagcaggttgccccggtgtctcaggtattggttgtcttagggcgaaaacgccgattgcgtggcattaagtcaccggctcttagcagtcggcataacctataccgaccgatcgaaacctctctccgaagcactgcttactgtattaatgaataactctctaaagccggctttcggtaggctttctttgcacctgaggtactgataataatggactatactcgtatttaatgtcagttcgatctaagcgcaaataggggagttgggtctggatcgaactgacgttatagttaaggcaataaggtttgcgacatcctcgtttagtttaggaacagcaatatgtgcattatgcttacctttgctcatcaaggagccgcaaccgcatggctgtaggcttcggatgcatttccaataatacacatacgacaaacaaatgaactttgtagaagaactgcgttggcggggtatgatccacgatattatgcccggtacagaggaacacttgaacaagggtatgacctcggcatacgtaggcattgaccccacggctgattcgttgcacatcggccacctcgtgggtgtgatgatgctgcgccatttccagcgtgccggccatcggcccatcgctcttataggtggtgctacgggaatgataggggatccttcgatgaagtcggccgaacgagttctcttggacgaagccactcttcggcataatcaggactgcatcaagcagcaactggccaagttcctcgatttcgatagcgatgcacccaatgccgcaaagctcgtgaacaattacgattggatgaaggactattctttcctcggtttcattcgggacatcggcaagcatattaccgtcaattatatgatggcaaaggattctgtgaagaaacgccttagtgccgagagcagcaccggtctgtcctttacggaattttcctaccagcttctgcaaggctacgactatctctatctatatcggaatgagggctgccgcttgcagatgggcggttcggatcagtggggcaacattaccaccggaacggagcttatcagacgcaaggacggaggagaggcctttgcccttacttgtccgcttattaccaaagccgacggtggcaagtttggaaaaacggagagcggcaacatctggctcgatcctgccagaacttctccttatgccttctaccagttctggctcaatgtgagcgatgccgatgccgaaaaagtatatcaagatcttcacgggactgaatcaggacgagatagcagaactggcaagtcgtcaggccgaggctccgcatctacgccccttgcagaagagattggcagaagagatcaccgtcatggtacacagtcgtgaagcctacgatgctgctgtcgaagccagcgagatcctctttggcaagagtacgacagagcaattgcgcaagcttgacgaggccactctcctcgatgtctttgccggtgtgccgcagtatcatgtggagcgcagcaggatagccacaggaatttcattggtcgatttgctggccgatgctaccgatatattcccgtccaaaggtgaattgcgcaagacggtgaaagccggcggagtgagcctgaacaaagagaaagtagccgatgcggaacaaacggtaggagaggacgacctcttgtccgaccgctatctgctggcgcaaaaaggcaagaaaagctattacctgatcatcgtggagtgaacacacggatagcgcattcatgaaactatccatcgttattgtcaattatcgtgttccgtatttcttggaacagtgccttctctccgtgcgaaagtctgcccaagggattgatacggaagtgtgggtcgtagacaataattcgggggatggttcggtagaatatcttcaaagtcgtttccccgaagttcattttgtagctaacgaggagaatgtaggtttctctcgcgccaacaatcaggctatccgtctcagtaaggggcaatacgtactcttgctcaatcccgatacccttatcggagagagtacgctgcgtacagtggtggactttatggattcgaagcctaatgcaggcggactgggcgtaaaaatgctcaatggtcatggccgctttttgccggagagtaagcgagggtttccttctccatgggtgtctttctgtaagttgtccgggcttaaccggctctttcctcattcgtctcgtttcaatcgctatcacctcagttatctcagccgtgacgaggtgcacaaagtagaggtactgtccggtgcttttatgctgatgcgtcgggaggcattggataaggtcgggttgctcgacgagcgtttttttatgtatggtgaggatatcgacctctcttatcgcttgatattgggcggatacnacaactactactatccgactcctattcttcattacaaaggagaaagttcgtcggtctccgatgttaaatatcttcgttcgttctatggggcgatgggtttgtttttcgataaatactatagaaacaggatgaatccactgcttcatggactgatcaatgtcgtcatcaaagcacgtacagctcttgccttgatgcttcgcagtctgaggaaggttccggcggcagagaaacctgccaaaatattctattggcatccttctgagggagaggctgctatatctgcctatcacgaccgcagccatatcctgatcaataccgatgaggtgacttgtgatcgcctgcttctgactatggagaaactggctgataggaagcatactttccatctgacgaatgacaccacgaaaagggtgatctcaccttgatacatcttcccttagaaaggaaatctcccaactgttttttttgaaagaaagaggccgtgtgtgatcgtattcggatcgccatggccgtttttgtttctcttccttacggcatagagtatacttttcgtttcacgataaattcaacttcctattgaattgcgaggcaatctgtatcaagtcaaaaagagacctttgcaaaatcaagaagtatcttttcggtatcgttttcacccgtagagcgtgtcgcacaagtcatagaggagctgaggtattcatacctataacgacacagaaaaacagtca

SEQ ID NO: 174 - DNA (genomic), 3302 bp, PORYPHYROMONAS GINGIVALIS; double-stranded, circular
  misc_feature 1...3302
  hypothetical: NO
  anti-sense: UNKNOWN
tccccgccacctcctgaaggaaatagttgtgcaatctgtccgtgactgccggaaaagatgaccccatagaaaatagaatcgataatattcccgataccgccggcaatgatcagagacaaacaagagagaaaggcgagtgtatgctctcgctttcgtaccaatttggccaataaatagatacaaaagcccatggcaacgatgcgaaagagactcaagaagagtttgctccctaattctataccgaaagccatcccgggattttccacgaaatggatctgaaaccaaggggcgacaacgtgcgactgccccagtaccatagtcgtcttcacccatatcttgatcacctgatctacgaccagaagcaagacaatgagagctgcgactacttttccctgaggcagacgggagagaaaagaagccatctactatttcttctcgttcattttggcctctatgctcagcgtagcatgaggtacggcgcgaagtcgttctttgggaataagtttgcccgtttcgcggcaaacgccgtaagtcttattctcgatacgtatcagagcagcttgcaagttttggataaacttcatcagtcgctgtgccaagcgtccggattcctctttcgacagtgtggctgcaccctcctccaacaccttgaacgtgggagaggtatcagacacatcattaccctctgaattgctgacgcccgcacgcaactgctcgtagtccttgcgagcctgatccaatttggccaaaattatttgcttgaattcttccaactcttcgtcggtgtagcgtgttttttctaccatttgtatctaaataatcgttagtggaacagatttctcggcagacagaaaattcatatctgcctccgaagtctatccctgatgtttaacaacttgtatgctaaggacaaaatcatcgaaatccagctccactccatcgctgacagcatcgctgatctccaacgattcggcctggatttgctgggcgatatagtcatggtgctctgccaccactttatccataatatcgttagacaagagaaggacatccaccttgtccgacacttcgaaaccgctttgcttgcggatattctgcacacgattcacaagttcgcgagccagtccttcggagcgaagctcatctgtcactgtaatatcagggctacggtcagattgccttcgttggctacgaagccatcccggaatatcttccgagacgatctccacatcggccaattcaagctctaccggagtcccggccacttccatccggaaagtgccggccttctcgagggagcgtatctcttcctgcgtcatggccgttacagcttctgccaaagccttcatcactttgccgtagcgtgggccgagtcgtttgaagtccggtttgattcgtttgaccagaatacccatgctgtcatccacgaatcgcagctctttcacgttcacctcactaaggatcagcggctgtacggattcgatacacctgcgctgctcatcgtctatagccggtatcatcagtgtagccaatggttggcgtactttcagattcactcttcggcgaagtgccagcaccatagacgaaatctgctgagccatctgcatgctctgttccagtgcacggtccacctgactttgatccggccgggggaagagcgccaagtgcacgctttcgtctttgcccgtcagatctcggtacagtcggtcagcatagaaaggactgatcggagccatcagtttggatacggtaagcaaggaggtataaagcgtctgataggcagagagcttatcttcggtcatatctcctgcccagaagcgacggcggctgagacgcacataccagttgctcagattctcggagacaaaatcgctgatggcacgaccggcacgtgtaggctcgtagtcgctcagttgatcatccacttcacgaatcaatgtattcagttcggaaagtatccagcggtcgatctccggcctcttggcgaaaggaatgctttcttcttctcccgtaaagccgtccaaattagcatagagggcaaagaactgatacgtattgtataaggtaccgaagaatttcctgcgtacctcttccactccgtccgtgtcgaatttgagattgtcccacggtgaagaattggtgatcatataccagcgaagaggatcggagccgtatttcttgatggtctcgaaaggatctacggcgttgccgagacgcttgctcatcttattgcctttcttatccagtaccaagccgttggataccacaactttgaacgaactcgttcctgatatcatcgtggctatggcgtgaagggtgaagaaccatccacgcgtctgatccaccccttcggctatgaagtcggcagggaagacggaaccgtcctccactcgttcgcgattctcgaaaggatagtgcatctgggcataaggcatagcacccgagtcgaaccatacatcgatcagatccagctcgcgggcgcataggctgacccgaggggagcaaagtgtgatcccatctacaaaaggcctatgcaggtcgatcttggcatagttctcctcggtgtagacaccgggcttgaagcctgcccatgggttgcgctccatcataccggctttgacggccttctctatctcgttgtacagctcttcgaccgaaccgatacagatctcttcggaaccatcctcagtacgccaaatgggcaatggcgtcccccagtagcgactgcgagaaaggttccaatcttgaagattctccagccatttgccgaagcgtcccgtaccggtgctttcgggtttccaatatatcttaccattgttggctatcatctcctctttgcaggctgtcgtgcggataaaccagctatcgagcggatagtaaagaacgggcttgtccgtcctccaacagtgtgggtagttgtgtgtcatcttttcgatgcggaaaacgcgattctgcatcttcagcatcacgcagagttcgacgtcgagagtctcgtccttctccgtctttccggcatcgtacgcatttttcacgtagcggccggcatatacgtcatagagcggcagatccatgtgcttctctacaaagacaggatccaaatctgtcgttgggaaatagcggccggccagatccaccatagggcgcatattcccctctttgtcacgaagcatcaagggaggcacaccgcttttcttggccacgcggtcatcgtccgcaccgaacgtaggtgctatgtgcacgatgccggtaccatcttccgtggtcacgaaatcgcctgtgatcactcggaaagcaccttcgcc

SEQ ID NO: 175 - DNA (genomic), 626 bp, PORYPHYROMONAS GINGIVALIS; double-stranded, circular
  misc_feature 1...626
  hypothetical: NO
  anti-sense: UNKNOWN
tggttcgctgccccaagtcgttgtacgatcgtcttcgcgaagaggatagagcgcgtttccgagtacccgtcgatattctgtccgatgaggacgatacggacggtacggaagaagaccccttcaaaaacacgctggtcaggcatcaggatcgcttcccctacttcgccttgcgatacttcgatctgaagaaagtcttcacttccctccgcttccatatagatttgggcacctaccacttcgccatatacaagaagaacatcggcgagcagccggaagaccgccatctgacgcgcaacctgtacggcttcggccgaatacaggatttcgccgaggagcatagacccgaagaatggaagcgtttggtgcgggatttggactacttcgagaccggcgacaagccctatatcacccaaaccactccgcactatcatatcgagaaaggaaagatcgggctgaggttcgtgccggaagggcagcttctttggccgtcgccggaggtaggagcaacccgaacgggacgaaagcaaatacgcccaagacaaacggttcacggcagaagccttcctgagcgtacatgagctgatgcccatgatgtctattacttcctgctgagagaaaagtatttc

SEQ ID NO: 176 - DNA (genomic), 469 bp, PORYPHYROMONAS GINGIVALIS; double-stranded, circular
  misc_feature 1...469
  hypothetical: NO
  anti-sense: UNKNOWN
cactgtttttggcattgcggatgggatcatggatgtcgataggttcgtggcagatattgtagtcaccgcacaggatcaagttagggcgactcttgcggagttcattgacataagattggaagtgctccagccaaaccatcttgaaggcctgacgctcatcgccactcgtcccggatggatgataaacgcttacgatagaaagatcgccgaaatcggcacggataaaacgaccttccgcatcgtattcttccatacccatgccatattctatatgatcaggctgatgctttgtgatgatagccacaccgctatatcctttcttttgagcccgaaaaaaagatacgagccggtagcccagtgcttcaaatccttcatttttcgaattggtcattctgcatcttagtttcctgcaggcacaagcacatcaggattctcttctcgaagccaaccgatcagatcttttcttcat

SEQ ID NO: 177 - DNA (genomic), 641 bp, PORYPHYROMONAS GINGIVALIS; double-stranded, circular
  misc_feature 1...641
  hypothetical: NO
  anti-sense: UNKNOWN
gtgaatagactcacgattgtcctcggcataagcatagccagagcaaaaccgagaaagctgaccagtagattgacgccacaactgtagcgataggccgacttcacccgtcccggatttttagccccgtagttgaaacctacgatcggctgcatcccctgagccacaccgatgataatcatgaaaaagagcatggcatagccattgataatcccgaatgctccgatggccaagtcggtagcatctgctgtctcgccgtaggatacgaaagaacgattcatgatgatattgaccagactgcccgtaaggtgcatggcgaagggtgctacccctatagccgttatgccgccgatcaccggcagggacaggcggaaagccgagcggtggaaacgtacgatactgtccttacggaaaaagtgcgaaaggacgtagaccgaacatactatcatggagacgacagtcgctatggcggctccgcttatccccatccccaacggatagatgaagatgtagtccagcaccacgttcgtcatagccccgatgatcatcgtaatcatggctttgcgcggatagcccgaaagctctcatgatagcattgtagccgaagcttcagagctgagaaaatattggcaggaccacgtatg

SEQ ID NO: 178 - DNA (genomic), 490 bp, PORYPHYROMONAS GINGIVALIS; double-stranded, circular
  misc_feature 1...490
  hypothetical: NO
  anti-sense: UNKNOWN
ttgcagtgatgggtccgagcggagctgtagaagtaatttttgccaaagaggtggcagcagccgagaatcctcaacaagcagcattggaaaaggaagaagaatatcgtcaggcttttgccaatccgtacaatgcagcctcttacggctacatggatgatgtgatcgagcctcgcaatactcgtttccgcattattcgtgctcttgaacagcttcgtacgaaaaagcaaactattccggctaagaaacacgacaatgtgcctctttaataagaggagtttagtgcatcgaccatgaatattagcaggtttagccatatccttctgactttgtttgtcatagcctccggacagctctttgcccagcaggcagcacagcttcgcttgaatgaagtgatgaccctgaatgtgcgngactatcaggacagctatggcaatcataagccgtggattgaaaatatacaatcctccanccgctacggtggatatcaaag

SEQ ID NO: 179 - DNA (genomic), 454 bp, PORYPHYROMONAS GINGIVALIS; double-stranded, circular
  misc_feature 1...454
  hypothetical: NO
  anti-sense: UNKNOWN
ctggaattggttttactgaggaaaataagaattcttttgatacatacagaagtggcttcaaaatgtcaaaaggaggtaaaggcttcggtcgatttatgtacctaaaatacttttatcatgtctcaattgaaagtatcttctatgaagagggcaaatataaacaacgtagttttacatttggtcacgcagatgagataatagaaaatgagcaaattgtagatattgaatccgactctgacctgcatacaggtacagttttacatctttcttccattaagtcttttgatttagataaagggcttgaagttattgccagaaaactcgtggagcgtttacttgtattctttgtccctggaggggaatatactccaaagattacgattaaagaagagaatggctccaattcaatagtattgaataactatattggagacaattctgatattcaacaaat

SEQ ID NO: 180 - DNA (genomic), 466 bp, PORYPHYROMONAS GINGIVALIS; double-stranded, circular
  misc_feature 1...466
  hypothetical: NO
  anti-sense: UNKNOWN
tgcaaaaatatcctttaccggctaaaactcagataaaatgtgtttttcattgcaaggatatgcgccactgacctgtcgaaaagagcgtgacaactactcgaaattgaacgtaagcataatcattcgggtgcgtgcccgactgatagactgggtatagatcaacttataatcatccaaaagatcaggacgctcgtgtgtgataacatcgggaaaaccaaagctaaagcgcagttcggggcacaatttgaaaaaaggcaggtaaaaatcgcatccgagaccgatctgcaccccgtaatcgttcgctttggtataaatctccaaccccttctttcgccccagctccatagtccagtaaggcccgccgatgaggtattggacgcataattggttcaagcgccgagaaccatattttcaataattagcggaaattccaaatatttggatccgaaccggagaaaagaaggcc

SEQ ID NO: 181 - DNA (genomic), 484 bp, PORYPHYROMONAS GINGIVALIS; double-stranded, circular
  misc_feature 1...484
  hypothetical: NO
  anti-sense: UNKNOWN
ggcttgcgtgtggatgagttcgggactgaaccacatacggctctcttttgtcgtggacagtgtgcggtgttcaaggaaatgcagaaaggcaggtatttcatccttcaccctttgcaggaaatccgtgtcgtccctctctatcctccctacttttcttacccaatagcgcgtctcccctgcgtcgatgatgacgggcaggtgttcgttgttggagcatagtacaaacttggcaaagaacgaaatctcgtccctgtccttatcctccgcctccaccttgtaggaaagggtggtgctgaggttcttgagccgctcgctgtcctccctgcggtcgagaagcacctngtccacgaggatgagcagtttcccagcctagtccgagttgaactgacttcgaaagtcctcgttggtgttgaaggttacattgctgcccaagagggctttgaggaaagtttgagaaattgtgctnttgcccgtgtttcgctnc

SEQ ID NO: 182 - DNA (genomic), 486 bp, PORYPHYROMONAS GINGIVALIS; double-stranded, circular
  misc_feature 1...486
  hypothetical: NO
  anti-sense: UNKNOWN
ggctgcgaatagcttgtaaatacgattgatctcaacacctgcagcttttaactcatttaaatactggacggggttttcatacttcttaaatgcattggttagtgatacctgtgtcaatcggactgttttcaaatctgtggcattcataaatggacgtgcagatacactgactgtaaaatgaccggctttttctgtgctaattgtcctgcttttctttactgacatagctatttgggcaaaaacttcacgctttttcttattaataaaatactggtataaatctatatcaggaatacgaggtgcagcagatttcaattgtaacgactcttttaccatcttgatcatgttattgacctctttgacatactggttggcagcgttaccttccaaatatagttctatcaagtctttcaagagtgcttttagtgaaatttcggacaaaatgcttattgatgaatctttttgtagagttgcgattctaataac

SEQ ID NO: 183 - DNA (genomic), 601 bp, PORYPHYROMONAS GINGIVALIS; double-stranded, circular
  misc_feature 1...601
  hypothetical: NO
  anti-sense: UNKNOWN
ggcgtaaaaatcgttatagaaccacttaccacttcaatgacaatacggaaaaggcatcccgcctgatacgatcatatacggtggaacatggcatggcttgttttgacctctctgcggctatggggggagaggctgaaacccgacaatggctgcgtagcgggctgatgcataccgatcatatacattatacggtgggtggatatacccgtcatggaggactggtggccgatgccttactcggctctattgtccgtggcaaaatggataggagcgaccagtccaaactctaaaataaaagacagtccaagatcgtgcactttttcgattcgatggatatatcccgcctgtgggatatattacagtatgatgcttctgcccccatgattttttcgagtgggacgttcttcatcctctttcttttgttccttccgctatacatcctgctacgccggcaaaccggactgcgtattgtatacgtatctctcttttctctttatttctactataagagcagcggtcttttcgtcctgcttcttttggctgctgctacgagcgacttcctcatcggtcggctttttgtcccgtcagcagatccaagtac

SEQ ID NO: 184 - DNA (genomic), 410 bp, PORYPHYROMONAS GINGIVALIS; double-stranded, circular
  misc_feature 1...410
  hypothetical: NO
  anti-sense: UNKNOWN
agaccgttccgattatgaaagcagctactaccgtcagccgtataaggattgttttcatcgttgttttcgtttatgcaatttgttcatataaagcctctccattacagaaagagcctgttttagtgagttcccgatagccataatccgttttgattttgtcgattatcttatcggcttcgggcttttccaatgcgaataaatatgcctgtaaagcatcgtaagcagtataattcttccaatcttctcctattttccttgccaattctctgactttctcataatcgggatgatatgctttgaaatcacgcataatcgtgtcggtggcatcttcatcatatccatcgcaaaaagttatgttgttcaaatagctggcatgttgaatgnaagtcgatacacccaccccgaatagt

SEQ ID NO: 185 - DNA (genomic), 2503 bp, PORYPHYROMONAS GINGIVALIS; double-stranded, circular
  misc_feature 1...2503
  hypothetical: NO
  anti-sense: UNKNOWN
tatatcagtccatttttctccacaccttcttacggtgggcgatacggcttgtgttccagctcagcaatgaagtcagcctgcgcaaagaataccagcgtgtacaacgtctgatgaacaagctcaagaaagagctgcgtgaaaggataacgcgagaggaacttcccgaaatatctttctcctctgtccttttggacggtgctccggaagatgtaatccttagttactgcaagcgacacagacccgtaatgatcgtgatggggacgcgaggcaaatcgcgcaaggattcggatctgatcggaagcgttgcagccgaagtaatagattcgagcaaggtacctgtgttggttattccggaagaagtgccgttcagcgatttgaatcaggccaagcatgtagcagtggctacgagcttcgaccaacgcgatctggtgctcttcgatgccatgatgaagctgctggacaagaacaacccttcgtacagcatcttcaatatctcagtgggcacaccggaatggaaccaagtgcaactcaaagccatcagggagtatcatgcgcatcactatcccgatgccacgatcaaagtgagcatgctggacgaaggagacttctcactcgctttggaaaaattcattcgtcaggaaaaggtggatatgattgtggtcaatacttatcgaaggaatttcttcgctcgcttctttaatccgagtatggcacgacgaatgctcttccatgccggaacaccgcttttggtaatgcacaattagtatctctccggcttttcggctgagaagctccggtttgcttcagagagccgtttagacctgataaaatacacctctacataaggactgcccgagtatcgaatggcagtcctttttccgtttgattttgtgttcggatgggggggaggggaagcccgtcatcggagtgttttttttaccctccgaggtagtatttttagctgcgtaaagtatgcttttgggcatatttacaggatgtatatttctgtcaaagtgcggatttctcatttttttttctgtaagtttgtgccgaacaaatatgttttaactcaagagtcagcctgatgaatccggcaaatgatgctgatatttttgatgtgctaacgcacttggaacgtctcttcggcgatagagagaaactctcggaattgactccaaatgaggcgattgagatttttgacaggctgagtcgtatcaacggtatgcttattcgtgaagcgtcaagacaaaaggagcaaacgaagcagcccgttgtgctaacggaaataacacctcaagaggggaaacaagaggagagaccctctcctgcaggcttcgatttgcagaagatagtctctacgttggatttttttcgctttagacgggagttgtttcaagacgatgacaagcttatgcgagacatctctgcccatctcggattgctgtcgtcagcggctgaagctatgatctatttgcatcagcggatgcaatgggaggcagaggatccggtggtaaatgactttgcggaagtagtgtcggatttcttccgtagaaggaactgaaccgtaggatttgcgatggaaggacgtttgacagtcgtgccgactcctatcggcaatttggaggatattaccttgagagccttgaaggtactgcgcgaagcagacctgattttggcagaggacacgcgtaccagcagtgtattgctccaccattacgacattcactgtccgctccagagccatcataaattcaacgaacatcgtacggccaagtcattggccgaacggatatccggaggtgaacgcatagctttgatctccgacgccggaactcccgggatcagcgaccccggttttttgcttgtcagagcatgtgccgagttgggtgtagtggtagaatgtctgcccggacccacagcattgattccggctttggtagcaagcggactccctgccgacaggtttgttttcgaaggttttctgcctgtcaagaaaggccgccaaactcgaatgaaagaattggccgaagagctccggacgatgatattttatgagtcgccccatcgggtgctcaggactctgacccaatttgtggagactttcggtctcgatcgaccagctgctgcatgccgggagctgagcaaactccacgaagaggtgatccgcggaacactcgcggaattactggctcacttcgaaaaccaccctccaaggggagaattcgttctcatcgtgggtggagccgccccgaaagggagaaaagaagagaagcaataagttaagaatgaatgaagtgtcacgctaataaaagtattacgaacatgaagaagaaactgtttatcgccacagcgctaactcttgccttggtatcatgtggaaaaaactccagtgcctataaagagctgaaaatgcagtatgactctattgcagcagtaaacagccaacacgaatccgaattggcagagatggactccattatcagtggagttctgaccaacttcc

SEQ ID NO: 186 - DNA (genomic), 518 bp, PORYPHYROMONAS GINGIVALIS; double-stranded, circular
  misc_feature 1...518
  hypothetical: NO
  anti-sense: UNKNOWN
atattggatgtgcccgtgaaagatgagaaagctgcctgctggcatgtctattccatcatcacggacatgtatcagcccaatccacagcgaatgaaggactggatctccatccccaaaagcaacggttatgagtcgctccacgttacggtgatgggaccgcagaatcggtgggtggaggtgcagattcgctcccgtcgcatggacgaggtggccgaaagaggattggctgctcactggaagtacaaaggtatcaagagcgagagcggattggatgagttcctcacttccgtacgcgagacgcttgaggcacgcgatcactcctcggacgattcggcggagacggtgaaaaacttcaagatgaacctcttcaccgatgagatctatgctttcactcccacgggagaactgatcaagttgcctcagggagcccagtgtgctggacttttgctttttgcccatccattngcgcatcggctgtcaggccgtcggagcttaatgtcaatggaaagaatgtgccg

SEQ ID NO: 187 - DNA (genomic), 4635 bp, PORYPHYROMONAS GINGIVALIS; double-stranded, circular
  misc_feature 1...4635
  hypothetical: NO
  anti-sense: UNKNOWN
tgctcgcaaacaaaaccaactctattcgacactggagcagaaaggattcgaccgcccctccactacgatgtggacttatgacgatcatatccgcgacgagatgaacaaagccatgagcctactgcgcgaaaaagactacgactccttccctgcagcatacaaagagatggctatcgttctgcgtgacctgatggaaaaagaagagcttatcctttatccaacctctctgaagctcatttccgacaaagagttcgaagaaatgaaacatggcgatcgggaaataggcttcttccttatcgacatgccggaattagatgcaccggccaagcaatcaaaagaagcccacggccaatcatttatggcagaactgggagccttacttgccaaacatggtatggggacaggcggacaagacgacaaggcgatactggatgtagccgaaggaaagctgactttggagcagatcaatctgcttttccgtcatctccctgtggatatttcgttcgtggacgaaaacgagctggtttgtttctatacggacacaaagcacagagtattccccagaagcaagggggtgatcggccgagaagtacgcaactgccatccgcccaagagcgttcatatagtagaggagataatcgataagttccgacgtggcgaacaggatcgcgcagaattctggatcaataagcccggagtcttcatctacattgtctatgtggccatcagagacgccgacgggcgtttccgcggtgtgatggaaatgatgcaagactgcacacggatccgtagtcttgaaggctcgcgtacacttcttacttgggacgaagagcaaagtccggcacaaggatcgaaagaaagcgaatccgatactgccggagaagacggcattcggccggacacgaagctgaagagtctcttgcagcggtatccgcaactgatggatgatttgccaacgatcagttccaagttcaccctccttcgttctccgatggccaaagtaattcttcctgttgccaccattaaaatgatgagcgaacgcgccgacattccgtcggatatgctcatcggcaaactggaatcgctcatcgcttcgtacaataaaccggatcgatcggaagagaaatagcatgaagaaggaggtgtgtcaataatcatggcgcacctccttgcattaatatgggacggtcgggtacaccgctattccgagactcctaaggagtccctaccgagacccctaaggagtctccaccaagacccctaaggagtctccaccgagatccctaaggagtccctaccaagacccctaaggggtcccaacagagactccttaggggttcctcaatgctttacttcaggaggggttcgtgcggtcttataatccattcgaatggagacatcgggagcagtgaccggcgaaaggaagccgaagcttagcgaatcttaccgtcgaacagattgatgatgcggccggcactacgtgcatcgtgctcggagtgcgtcaccatgacgatggttgcaccttcgcgattgagacctctgagcagttccatgacatcggctccgtttttggagtcgaggttacccgtgggttcatcggcgaggatgagcttcggattggccaccacggcacgggcgatagccacgcgctgctgttgtcctccggagagctgattggggaagtggccggcccggtggctgatgctcatcttgcgcagtgcctcctccactcgctctttccgctcggaggccttcacacccagatagacgagcggcaactccacgttctcgcttaccgtcatctcttcgatgaggttgaagctctggaatacgaagccgatattgcccttacggacggcagtcctgtctttttcccggaggttgcccacttctgccccatcgagcttgtagataccggaagtgggattgtcgagaaggccgaggatattgagcagagtggacttaccgcatcccgaaggccccattatggcgataaattcgcctttgtccactttgagcgatacgccatcgagggctaccgtctctatttcttctgttctgaaaaccttggtgaggttgctgatttcaatcattgttttacttgtttttatgaggtgaaaggaagagcgacaagccggacaatgcctggtctatgaatccgccgtttgccggattgtcgccgtatttattcgtatcggagttcattgacagggttgcggcgagctatgcgccggaggttgatgacaacggccaatgcaataatcaggaggacgaacagacctacaaggaggaaaatccggccgttcaattcgattcgatagcttgaacttctccagccagttccgaccgaagagataagcgacgaaaagtccggcaagcacactcggcaggctgagccgaaaaatggagcggaggaagagtcgcaagatgtcgccctctccggctccgttgatcttgcgaatggccagctccttgcgacggcgattgacctccgtattcacatagccgaccagcccgatcagagcgatcaggatagccacgacactgccgaagaggatcgtattgcgaaaagtcttggctgcctcgaagcgactgagaagctccatctccacaccgaggaaagaagtctccttgtagggatcggcttcggagaggatgccattcacgcgatggaggagccgggcatcgtcatggcgaaggcggatcgtcagataatgcagccaatcgtccccatagacgatggcggaagggagcttttcggggtaagggctcaggtgctgacggcggagcatgagatcgtcgtacacaccgcgaatcaccactcgcccgaaggaagtcaggatgatattcttgccgatgacaccgtctttccaattcatcagccgagccaattcggtagccgctttcttgctgagcatgatctctctgtccttttcggtggcagcgtcgaagtttttcccttcgagcaactcgatgtcgtagactttcagatagtgttcgtccacgtagaagaggtcggccacattgatcagctcacgatccgtaacggggtcgataaggttatctccactctggccggaagaagccggcaaggcggtcgtcagcgtgtagccttccacttcgggcagtgccttgagcttttcgatcacgacagggagttgctgctgatccagcgactcgatggggacataatacagtccggcggctttgtatccggcatcctgccctatcatgtgccggtattgcagaccggtgatagccaaaaggccgaagaggaaagtggccgccacaaattctacagccagcagtcccagcttccagagccgattgtgtgctaccgacttgcgaaagatattcatcaccggtgtacgggacagggagtagccggggatccatcccatgaagaaagtagccatggccaatactccggccaaggctgcggctacgcgccacgagatcagatgcagcagcggagtttcgatcagagcctccatcggcttgcggaagaggataagggtcaggagggccagcacgagagagaggaagagatagaggaaggtctcccagatcatcgtaccctgtatctgcacgggcatggctccgtaacacttgcgaatggcagctacacgccggcggttgaccatggaggcgagggtcatgagtacgtagttcagcagcgaaataagcagcaccgctatggccacgatctgctggattcgcagcatattgaccaaagtgggatcttccagacgcaagcggttgaagggcgtaagggaatagtgcaattccactcctgctttgcggaagacttccatatcctgatgccgcttttgcatctccaggagagcttcgtcgaggctctcgggcgacacaccgggacgcagacggacgtaggctatgtagcggtcgttgccgatccagttgttcaggctctcggccggcatccacgtaatgggcaggagcatatcggcttggatgctgctgttgtggggcagatcctcgaatacacctccgatcgtgatggctcggtccgatttgctttctgccggtcgcaaccgtttgcccaggacatcgccccccatcttccgggccaaactttcggagatgaggcaggtcatattgtcgcgcaaggcactatcccggacgccggcgatgagttctaccccgaacatgtcgaggaaagccggttcggccagcagcgtcttggtctcgtaggttttgttgtcttcgagtatcatcttcgaggtgccatacagagtcgttcgggtagccagttccacacccggtatttcctcctgaatggcaggggcaacgcctccgctgacctgagagaagtcgagttcttccggtttatccccctcctgactttggcgcgttccatgcgtcttgacgatgcagatgcgatcatgatgggggaaatcccgttcgtagcttcgctgatagatgacgatagagagcagaagcacgctgacggaaagtccgagcgtaagcgtcaggagtttgctgatactgtgttcgccctgtcggaagagacggcgagcagcaagtttgagaggtaacatgatgtgctatatgtcgtttaaggttgttattcgtttttgaggtaatccacgggattggcgcaggctgcccgcc

SEQ ID NO: 188 - DNA (genomic), 2086 bp, PORYPHYROMONAS GINGIVALIS; double-stranded, circular
  misc_feature 1...2086
  hypothetical: NO
  anti-sense: UNKNOWN
actgcactgaaagactcgccatacagatctcgtcccgattctttgggcgaatacaatttcctgttcatggagcatcagctcatcgtagtagtcgatcaaagcctcggccgacgcacctccacccgtatattgggacatctgcaaaggtgctccggcagcatccgacaggaagtagtagccatgcgtactgtatgtattcaccgtatgctccatggtggttttggccggattgtagaaccatgtcaccgggcccacggcataagaaatacagcgcatttgccctgacggagtaccggtaccggaggcaaatcgtctgtcgtgatccggctcagatcttcgggaagcacccctccaccataaccgaacacacctaccttggacggatcggagaagccattggcacggagctgttcgtccgtaaggcgatacactccacttgcatcgacacgtatcttgacccaatgtcccgaagccattagcgaacggtcggccgtcttccccatagctcgttgcgctttcgcaggcaaagcaagggcaaggaagagagaaaggaatgcgactattggaagtattcgtttcatctgagaaatagcttatttgatggatatgtcgagcagtttttgctcttcgagataggcttcgaggtgctgcccgatagcaatggggcctacccctgccggagtccctgtaaagataagatcccccatacgaagtgtgaagaaacgactggcataagcgatcaaacgatctacggaaaagagcatatcccgtgtattgccctgctgcaccgtgcgtccgtctatatccaatcgcaggcccaattcctgcacaccgtgccggagcgagtcttttttcacccaccgccctacggcagcggagttgtcgaaagctttggccgttgcccagggcaaccccttggctttggcacgacgctggaggtcacgagccgtgaagtctataccgacagtaacctcactgtaatagcggtgagcaaaacgttcggctatgcacttgccgatacgatctatacgaaccaccagctccgtctcatagtggatctcctgagaaaaatccggatagaaaaggggatgcccttcgcgcaacaaggagtcggccttgaggaaaagcacaggttcctccacacaaaaatcggctccccctccatccggacagggagcaacgggaaggatgtccgcacgtcgcatttcgctgacatgcgcaccatagttcatgccgacagcaattatcttcatcgttccaaagcgagcgaaagcccttattataaaaaagggcaaaggaggattgttcagccttcggagacctaaggtagcgatttcatccgattgaacatcacagccaactgggcatacatcgacgtattctgtacgaccacgccttcgggtacactgatgcgccaaggggtaaaattccaaatagccttgatccctgctgctatcatctcatcggccatcgactgtgccgcccgtatcggaacggtaagaatacctatatccacacgctctcgagcgcacaactccgcaacccggctcttatggtaaacggggatgccattgatattagtgtccacaatatccggattcacatcgaacccggcggcaatctccaacccgaagtggcgcaaacccgagtcctgcaacaaagcagcacccagacttcccaccccgaagaggaaagcacggtggtggtgcgtaaagcccagaaagtcgttcagcacagccaccatgtccgccacccggtaccctacccgtgtacgcccatccaccgatacataggagagatccttggccacgagcgaagcatccactcctacggcacgagcgatccgcgtggaagacaccgactcgcatccatccgcatgcaaaagctggacgtaagacaaataccagggaagacgcctcagagtaggttcggggacttttgtatcaagaagaaaagactcgttcgcaatcgttttcatccgttttgtagtggattatttaagtacaaatatatgtaatcacaccgtaataccttatgtctctgtcatatttacccctcagatgattgctcggaaagaggtttagga

SEQ ID NO: 189 - DNA (genomic), 3315 bp, PORYPHYROMONAS GINGIVALIS; double-stranded, circular
  misc_feature 1...3315
  hypothetical: NO
  anti-sense: UNKNOWN
ggctcagtccggacaggagaaggccaaagagggaggggctttcgatcaggccattgtcaaagggcgaaaggccatccacctgcacagtattcgtaccaaaccggagcgtaagcaaggttggcagagcgatcccaaagccgtagctttccagaacaaaagagaatacaaccgctttctgcacaatgcctggatgctcgtgggcaaatcgcagttctataatgccgatttcctgcaggcgcaggctacattttcttatatcgcacgcttatacagcgacgaaccgataatccgcgatgaagcccgtctttggcaggtacgctgctacagtgagatggggtggctgcatgaaggggagcgtttgctcgagcgcatccctaaagatcttccgcatgtcgatcgtagagggttgtattctttggcagtggcagagcgttcgatcctgtcgggtgacaagcgcgcggccataccttatctccaacaggcagcaagacaagagaaaaacaagcgacaacgcgctcgtatgtattatctgctcggacagcttttacaggaaaacaatcggccggaggaggctcgcaaggcctattccaaagtgttgcgggcttctccgcctttcgctttggactttgccgcacggatcaggaagatggagctggagggtgaacggaatccccgtacagtagccgctcgattggaacggatggccaagaaaggcaagtacaaggatgtattggatcagatcttctatgcagcaggcaatatatacatggatattcccgatacactggcggcgatcaaaacatatactaccggaatagagaagagcacggcacgtggagccgattttgccctctgccagattcgtttgggcgacatctatatgcaaaggaagcagtacctgaaagctcagccttgcttctctgccgcagccggtgtactgaacagactcaatcccgactacaagcgcgtagccgaactttcctcccggctcgatgaattggtcggtcatgccaaggtcgtgcacgagcaggacagccttcttgctcttgctgccatgccggaagaacagcgactggccattatcgacagcgttatcaatgcctatgccatagcagagaagaaacgactcgaagaggaggagatggcaaaactccagcagagccaagagcttttcaatgcggagagtgaaggattcgctccctctgccggcggaaagactcaaaatccaccgcccggaatgcaaatgggaggagcttctggtgaattctatttctataatcctcaactgatagcgcagggcaaagccgctttcgaacgcaaatggggaaagcgtgtgctggaagatgattggagacgtagacgcaaacaggccaatttcgacattcctactgacgattcttctactgcagaagagactgatgagacgcaacccggaactttgatgaccgaagaggagctacaggcggcagctgccgattccgcaacttccaatccgctcaaccgcgaatactatctggcacaattaccaatgacggaagatgccaaggaagctgccggcaaactcattgcagaaggtctgctcggcatgggagcggtcttcaatgagcggatggagaagttcgacgaatcggctgacacttacgagaccctgcttcgtcgctacccgaactatgagaagaagatggatgtgctctatcgtctctttatgctctacacccgaatgaacaacaagccggaagcggaacgttgccgcgccttgatcctacagtactatcccgaagacaatctggcaaaggccctgagcaatcccgattatctgaaggaattggccgcaatggatcgtcgccagaacgaactctacgggcaagcgttcgactcctacctcaaaggagtagtcggttcggtcagaaagagcagaaatgaatgccgcgagcgattccccctatcggaactggcgccgaaattcgacttcctcaatgcactctgttatgtgctggagtcagactccaagggcttcacctctgccctgaagcagttggtgaaggattatccgaaagcagacgtcaccgaattggcctcctcgatgcttaccgagttgctccgcggccgttccatcgtacagggcggctatacgggtatcgactgggatattcggtggggcagttcggataccgacagcatatcgccggactctttgcctccttttgtaaaacccaaatctttcgagcgtacccgtctgatccttcttgctcctgccggtacattgaataaaaacagggtactttttgctcttgcttcattcaacttctctcgctatacagagcaaacactggaaatagtgcagagcaccgtgggagcattcgatcagtggctgatgacctctctcccgaccccacgcatgggctggcagtatatcaaggatgctttcgctccgaacggatttatgagtgcgatgggcgaaagcagcctgttgttccccatatcggagagcaattaccagctgcttgtcaagggtaaaagcataggtcaatacatgaccttcctcgcaaaagaagaagtgcccgagacggccttcgtcctcgatcgctggcagcagatgaccggacgagcgcaagctgtcggcaaagaggatgaggacatagagcctgctggcactccggctcctatcgtgtccgacaagaacgaggccgaggataccgctcgcgatagtacgtccggcacagacaggaaacctcttgtctccatcaaaccgcacaaggacagcattatgacggctactcctattactttcgacatcgatagggagcagatcctctccggagccaagcctgtggcagccgattcttccgcagccgatacgatctcagatgcagctgctttgccatcgctcaagcagcaagaaggcaaagacgtctcggtagagcagattcagcggctggccaaagagcgtgcacaaaatgagaaggacgaaaagaaagcactcgaaaaggccaagcgagaaaaggagcgcgatcgcaaacgagaattgaaagcacgggaaaaagaacgagaaaaagcccgtcgcgacaagcttaaggatcaacgtctcaagcaaaaggaacgcgagcagaagcttaaagaaaaagaacgtgagcggaaggagaaacttcgtcaacgcgagcgagaacgtaaggcacgagcgaaagaacgcgaacagaagaagaaagccggacagaacaaatccggcggagggccccaatanggaaactattattcttcaaacgttatgaagccttaaggcattattatcatctatgtgtagtacttcttatgact

SEQ ID NO: 190 - DNA (genomic), 578 bp, PORYPHYROMONAS GINGIVALIS; double-stranded, circular
  misc_feature 1...578
  hypothetical: NO
  anti-sense: UNKNOWN
cgtgtctttccattcagataaaatcaaagaggcgaaagaggatttggcttgcttcgagaaacgagtggaacgggatgcagagggacttccaatcaacaaactcacaattaagggtgtagaaggaagtacggacatcaaggttattgctgctcgcttgcaggagatcgaggagaaagcacgcaccaagggtgaatacaataaaatcggtgagatttatggcttttccatcatggtcaagacggaaaactcttcaaagagttgttcgactgctcctccaaccgcttttcgtgaaagggcangagagcatctactatacctacaataacgggaagttggcttctgatcccaagcttgcttgtcagaactttatcaatgctctcgagcgtattccaaaggtgattgaatcacaccgagaaagataaggaaaaggtttctgcaaacaaggaggtctatatgaccattgcgggtgggtcgtggaagaaagaggacgagcttcgctctctcaaaggacaggcagcccgaactgggatagaaaaattgcactcacgctcgcacctcccggaggaagagaaagaaac

SEQ ID NO: 191 - DNA (genomic), 4112 bp, PORYPHYROMONAS GINGIVALIS; double-stranded, circular
  misc_feature 1...4112
  hypothetical: NO
  anti-sense: UNKNOWN
tcagaagagaattttatctatctctatttgcaaaagaaaaagccaacatatatagaagaagaaaatttgatattttggactaaaggatttgttgcaggcctaaataaagactttataagtgcatctcatatcctaatgccatatttagagcatgcgttgcgtaatattgctgaaatcaagaaaggaaacataactactttagagaaaaaacgacaagaggctccttctttaggtgtaattttccctatgcttcaaggtgtaattgaagaagaaatactgtatgaaatagaatcctttctaaatcatgggatagatgtcaattttaggaataatttatctcatggacttctaaccccttttgaaattgaaaaatatgggatttatttgtggtggatatgcttaaaactatattttgaagaaaagaatatgataaaaatcgctccctaaatttataaaagagataaagaattactagccttacggcctctgcgaggcttttgaaaaccagatgaaagtgaataactttgcattttggcatcaaaattcttgctgaatccaccctaagtgtgcaaaatatctctgtaatcttatccttggtaatcatatggtgtgtaattcgttatttttcaagaccaaaacacacaaagtaaccctgtaattcccaacttctataagacttttcttatcctgaactcacgtaattctttaatgcgaagcaaaagttgtccgaaagaaattttgtttccgtaaataaaagattcctgcaaagctgcatagtcgttcttccaatcctttatacattctacaggaggataaaactctatttttccggataatctttatcacagtcagcatagagaaccggacttacaagaccgaaaagcgtatatactccgaatacatcgacagaaatacaaaaacaagtcgtcattttccaccgataagaacgacattttacaaagaacagggacgagcctgccattttgccggggacgacgtatcgttccggttaggacgaccctccgtctgttttaggtcgacctgactttctgtcagggtcggcgtgtgtggtttattgtctcgtaatgtgcaggtaagaagagggttaagagtcgatatttcgggaacggataatctttccggatttcgtcctcggaatgcgttccgtatatataatctcccgggggatggcatgacggggcaacagtcttctgaaaaccgcatccatcctcctgcgcttttccggcggccactccatatcctccaccaccatgacgatacgttccccgagacgtttatcgggcagagaagtaatataaaaagggacttccatctcccggaaaacgaggtcttccagttcctcgggggaaaatttgatccccccgctattgattacgtaatccaaacgccccttccacacgaaatgcctttcatctacgagctccaccatatcccgggtgcaaaactccgattcccgaatatggggagcatgtatgcaaagacatccggattcgtcccggcggaaacgcactccttccaaagcctcgaaacaagcggaagctccctctccgttcaatcgcataagagccgtatgggatgccgtttccgtcattccgtaagtagcgaaaaaacgggtgggaatatccgccaaccgctctctcgtagtccgtgccagggggcctcctcctatcaaaagattttccaccttttcgaaccggtggctttcccccgatgacaggatgtcctccacttgcaggggtacgagcgctccgagtttgaccttcgtatgcagggaggaaagaggcaaagaagagggaggttccggcaacagaacggcccctgcttcgaatgccctcaccaccatcattttaccggctatataagaaagcggaagagagagcatcagtacggaatcccgggatatgtcgaaaaaagcattggtcagccgtgccgaagccgccatcgcttttttaggcagatggataagcttgggcatacccgtagagccggaagtacgcacctctataaaatcccgtgaatcgcaccattccgatacgaatgcacgcaatgcggatttccacggaacatcatctcccaaggcgccggcggctatctcccgcaaaccgaaatacctgtcttcatacagaattttcataagcctccgtttccatatctttcccggaacaaggcctcgacatcgcaacgggaagatctcttccctgcggcatatctcaaataaccgccttccgtataaagaggcgtatccgtattattcgtaaacaaagcgcccgtacccaatccctgaggcaggggattcccgtgaatataggtccactgggcaatggcattcaggcctatattcgactccaaagcggaagtgatccaccacgctatccccatggattcggcaatccttatccattgctccgtgccgtaaaaacctccgacaagtgaaggcttgagtacgatacaggccggacggatataagccaacatctcccgtttggaagtttcatcgtataagcctatcaattcctcatccaaggccacggcaacaggggcattcgccgcaatcctgcgcatagccgcgtaattcccgtccctgacgggttgctccaccgaatggataccgaaggcggataaacgttccaatttatacatcgcctcctcttcttcgaaagccccgttcgcatcgagacgaataacggcatccttcccgaatttctcgcggaccatccgtaccaaagcgagttccgattcgaaatcgatagccccgattttaagttttatacagcggaaagccctcctccagtttctcctccacacgccttcgcatagcttcgaagctccccatccatatcaaaccgtttatgggaatccccgcctcgccggaagtgaaagccgagggaaaaagcaatcccccgccctcgaagtcggcaagcgccgtttccatcccgaaacacaaagaaggatatgcctgccaggcgtcgggagtaaacccgcaaacgccgttgcaaacctccgccagccgctcttcgtaatccgctccctcttccgcactcaatccccggaataaagccgcctcgccgtaacctgcccgagaggggaaagtatcgtcgtataccctcacgaaataagtctgcttggtatgcaaaacgccccgcgacgtccctgccggctccttgaatttcaaggtataggggatataatcggccttaagcatcaacccgggaatttagggaacttgtcgaaatccggagtccgcttttccaaaaaggcatttttcccctcctgagcttcttccataagataatacataagggtggcatcccctgcaaactccatcaatcctctctgaccgtcgagctccgcattcaaagcccgtttaatcatccggatcgccatcggactccggctcaatatcgtcttgcaccagtccaccgtttcgtcctccaacctcgcggcaggtaccaccttgtttaccatccccatagcttcggcctccgcagcggtatactgacggcataaaaaccagatctccctcgtcttcttctgacctacacaacgggcaagataagaagaaccgaaacctccgtcgaaactcccgaccttgggcccggtctgtccgaaacgggcatgctcggccgctatcgtcaaatcgcataccacatgaagcacatgccctcctcctatggcataaccgttgaccatggcaatgacgggcttgggcaaagaacggatggccttatgcacatccaatacattcaatcggggaacacctcctccgtcgatatatcctcccattcctttcacatgctgatctcctcccgaacaaaaggccttatcgccggctccggtcaaaacgactacgcctatatccggacgctccctgcatatatccatggcatccagaatttcggcattcgtctgcggccggaaagcattataaaccttaggccggttgatggttatcttggctattccctcgaaatactcgaataaaatatcctcgtatttctttatttccttccattctctcatattcatctattttaattgtaagttctatcggtttacggggtaagactcccccgaaatatatgtaaaatacg

SEQ ID NO: 192 - DNA (genomic), 487 bp, PORYPHYROMONAS GINGIVALIS; double-stranded, circular
  misc_feature 1...487
  hypothetical: NO
  anti-sense: UNKNOWN
ggccgaactcgtagaaaaccccctctatctgggttgtctcattgtaaagagtggagatgccgatggactgattgccggcgcacagaatactaccggcgatgtacttcgtccggctcttcaagtcatcaagacagctccgggcatgactagcgtgagcggtactttcttactcttcaccaaagccaaagaatatggcaaagacggacttttgcttgttgcagactgtgctgttatacccaatccgacagcagatgagttggcacagatcgctgtcgctacggctcgtacggcgaaagccattgccgatattgaaccgcgtgtagctatgttgagcttctctacgaaaggcagtgcaaaacatgaaatgacagataaggtcgtagaagctactcgtatggctcaagaaatggctcctgatttgntgatcgatggcgaaatgcaagcccgatgcagctttggtagaaagagtggcagcactcaaagctcc

SEQ ID NO: 193 - DNA (genomic), 556 bp, PORYPHYROMONAS GINGIVALIS; double-stranded, circular
  misc_feature 1...556
  hypothetical: NO
  anti-sense: UNKNOWN
gatcgcaggatcagattatccccgtgaagttgagtgatttaagacggattacaaaagagtttatcgccaaccccacgaatcgtgccgatcttcccgagaaggaaaagcgcgaggtagtagggcttggtaccatggaactggttacttcttcttatgctatttcgatcaaaaatcagatcgagaccagctatcagatgtatatcagtgtacaaaatgaactcattgctgcatataacgaagtttgggacgaatttgctcaaaagtatttccacaaaccatacaaggagcttactccttccaagcagaaggctgttttagaagcatatccgntgcacatttcagaaatgccgttgtctaatctcaagtaaagaataaggaacaaaatgggaaagtttaataaatccggcgggcgtgaaatgcccgaactcaatacctcgtctttgcctgacttggtttttgcgttcctcttctttatcatgatggtaacgacaattcgtgaggtgacgcccaaggtgtcgtataataacctncctaaagcgactgaattgaccaagct

SEQ ID NO: 194 - DNA (genomic), 5402 bp, PORYPHYROMONAS GINGIVALIS; double-stranded, circular
  misc_feature 1...5402
  hypothetical: NO
  anti-sense: UNKNOWN
gcaaaaaactgcagagaaagttaggccctatctccatagccactccggaagctctcttgaatgcgcatgaaatgctgagagacaagatgcactacttcatcgagcagacgcaatgcagtgtgggtatttttattcatcgtggattcaagcatgcgggtaaggtcttgctcctgatggagaatgaaggtgacgaagaactcctcgcttatgctcgttcgttggctcgcaacaatggcagtgtgctcgatgtactacccgagaccgatggtttaccgccgactctatccatgggagaaaacagactgaaagccggattgccatcgacaatcaatatcagcagctaccactttatgctcgtcagctaccgctattggttgcgctttgccggtgagtgtccgagtgtgatcgagcacttgccctctaccatcattatccatcatcgaaatgaccgctcttcgacattgaaagctgcaatgatatgagaataatcgaacaagatccttggctgcgcccatatgaatcagtaatagaaagcagactgaagtatgctcgcaaacgagagacggatttgaccggaggaagatccggaggattgagcgacttcgccaatggacatctctattacggtcttcatcaggacggggattcgtgggtgattcgtgagttcgcgcccgaagccacggccgtatatctgatcggcgaactttcgcgctggcgtagattgccacagtttcggtttgcgcctgtggatgaagcgggttcatgggaattgcgactttcatgccgactgcttccgcatggctctcgctacaggctcttcttcgaatggcccggtggcgaaggagagaggataccggcttggtgcaaccgtgtagaacaggatcctgaaacttatcttttctacgcccaagtgtgggtgccggatactccctatgaaatgaaacaccctcatcctaaccgtaaggacgagcctttgctaatttatgaatgtcatatcgggatgtcgtccgaggaggagaaggtcagcacatacgaagagtttcgacggaatatcctcccccgtatctgcaaggacggctataatgccatacagctcatggcgatacaggagcatccttattacgcgtcgttcggctatcatgtgtcgagtttctttgctccgagcagtcgttttggaacgcccgaagatctcaagcgtctgattgatgaagcccacgctctcggcctctacgtgatcatggatctggtgcattcgcatgcagtcaagaacgaggtcgaaggcttgggcttgtatgacggcacgcatacccttttcttccatgacggcaatcgcggactccatccggcttgggattcgtattgcttcgactatggtagggacaacgtactgcacttcctcctttccaactgcaaatactggctgacagagtttggattcgacggcttccgtttcgatggtgtgacgtccatgctatactatagtcatggactcggcgataggttcgacaattacgacagctattacaacggccatcaggacggcgatgctattgcctatctgatcttggccaacaaactcattcacgaactttgccccgatgcaatcacgatagccgaagaggtaagcggcatgcccggattagctcttcccttggcagatgggggatatggctttgactaccgtttagccatgaatatccccgatttctggatcaagctcatcaaagagcatcgtgacgaagactggaatcccggcgacatctggtatcaactgaccaatcgccgtcaggaggaaaagacgatcagctatgccgagagtcacgatcaggctttggtcggggacaagacaatcatatttcgcctgatcgatgccgatatgtattggtatatgaacaagcagagttgtgtacatagcgtggacagaggcattgcactgctgaagatgatccgtctcttcactgccacgacgatgaatggtggttatctcaatttcatgggcaatgaattcggacatcccgagtggatagacttccctcgcgaagggaatggctggtcgtacaagtatgcccgcaggcagtggagtctggccgatagtcctttcttgcgctatgcaggtctgcacttgtttgatcaggatatgatagccatgatacgatcggtggagagctttcacaaactccctttgcgcgaatactggctcaagagagaagagcaggtgatctgttacggtcgaggcgatttcttcttcgttttcaattttcaccccgaacgttcttattcggattatcccatccctcttccggccggtaagtattcggtagcgatgagtaccgatgcacggaagtacgaaggtttcggtcgtgtggacgaatgggtggagcactttactcttccggatgggagtaaagatcggtttacccatgaacagtatttgaacctctatctgccggctcgctctgctctcgtcctgaagcttgccgaatgacagcttccccttcctttttttcaaatcccccctctaactaagattcgatatgaccgagcgacttttccttcttgatgcttatgctctcatctttcgtgcctattatgctttcatccgtagtccgcggatcgactctaccggtcgtgacaccggagctgtattcggcttttgccctgaccttattggatatactggagaaggagtcgccggagcatatcgccgtggtattcgatcctccgggaggtagttttcgtcatcgcgagtatgcagagtacaaggctcaacgagaggaaacgccggaaggtattcgcatcgccgttccgttgattaaagagatattggcagctttccgtattcctgctgtagaagtgccggactttgaagcagacgacacgataggtactttggccaaacaagccgaagagcaagggcttgccgtcagaatggtaacgcccgataaggatttcggccaactggtgtcggagcgaatcaagatctatcgacccaagtcgggtggtggctatgaaacatgggggccggcagaagtctgcgaaaagttcggactttccatccccgggcaaatgatagattacctcggcctcgtgggagacagctcggacaatatacccggatgtaaaggcattggagcgaaaacagctgagaagctactggccgagtatggaagcatagacggcatatacgcccaccaagatgaattgaaaggagctgtggccaagaaaattcaggagggggaagagcaaacgcgcttctcgcgctacttggccactatccgcacggatgctcctattgtcttcgattccgaagcctatcgacgtacttcgcccgatatggcagccgttcgtgaatgctttgctgcactggaatttcgcactttgctgaaacggttggagagtacacctaccgatgcccctgcgacagacctgtttgccggcatggtacaggcacaagagcctccgacagatttgttcggagaaggcaccgatgctacaggacttccgctaaagaaactgacagacgtaccacacgaatatacgattctcaaaaccgaggaagagatagcggattgcatccgaatgttctctgccacgccttgtttctcattcgacacagagaccgactcgaaagatgcacttcgggccaatatcgttgccatcacgctatgtgccgagtcgggacgggctttcttcataccgctgccggaagacgaagaaatcggaaaacgcagattagatctcttgcgtccgctttttgccgatacagctatcggcaaagtcggtcagaatatgaagtatgatatccaagtactctcccgatatggtatagaagtacgcggacagctattcgatacgatgatagcacactacctcctctttcccgatctccgccacaatatggatgagatggcggagacgttgctgggctattgcaccgtccactactcggatcttgtcggaagcgacaaacaggaggtgcacatccgtcaggtaccattgcagaatctggcagactatgccatggaagacgccgatattacttggcagctatatgaacgcctcaatgctatgctctccgaggccgggatgacctccttattcgaaagtatagagatgccactcgtgccggtgcttgccaatatggaacgctccggcgtaaagctggacacggaggtgctccgacgcacagcttccggacttggcgaagagatgcagcgaatcgaagatgaaatctaccgtttggccggacactcattcaatatcaacagtccctctcaagtgggaaccgtgctcttcgaggaactgcaaattaccgaaaagcccaaaaagacgaagtccggcagctactctacaaacgaagaaattctggtcaagctacaggaaaaacatcccatcgtgcgtctcatactggactatagaggaatcaaaaaactactcagtacctatgtagaagctctgccggagatgcgctaccccgatggtaagctgcatacctcgttcaatcagaccgtcgctaccacgggacgtctctccagcagcaatcctaatctgcaaaacattccgatccggaccgaagtcgggagggggctgagggctgctttcgtaccggacaatgacgaatgtattttcatgagcgcagactattctcagatcgagctgcggctgatggcgcatctgagtgaagacgagagcttgatacaggcttttctccatggggaagacatccaccgagccacagcctccaaaatatacaggctgcctcttgtagaagtcacggatgacatgcgccgccgagctaaaacggccaacttcgggatcatctacggcatctctgctttcgggcttagcgaacggctcaatatctcccgtacagaagccaaggccttgatcgaaggttactttgcctcttacccgggggttaaagcgtatatggatcggagtattgccgaagccaagcgacagggctacgtcaccacactgttcggtcgcaagcgattcctccgggatataaacagtgccaatgccgtcgtccgcggctatgcagagcggaatgccatcaatgcccctatacaaggctctgctgccgacctgatcaagctggcgatgatcagaatacacgaggaaatcactgagcgtaagctgcggagccgaatgatcctgcaagtgcacgacgaactcaacttcaacgttcttcgtcctgaagctgcagaagttcgcgagcttgtacgctcgtgtatggagggggtgatgccctctttgcgtgttcctctgatagccgagatcggcgaaggagccaattggctggaggcgcactgacgccattttccacctgacataatcccgaatagtcccatggacagttgtataaaaacgaaaatcacagcgaattgaggttcggggat

SEQ ID NO: 195 - DNA (genomic), 862 bp, PORYPHYROMONAS GINGIVALIS; double-stranded, circular
  misc_feature 1...862
  hypothetical: NO
  anti-sense: UNKNOWN
gccagttcgttttccaactgattgcgcacttcatttgctttccgctgacgttcgtaaacgtttttgcgtaactcttcctcgctttcacggtgacaggtctgacaggtgcggtccatgtgtgccaaaggactcgtgatgtgatgatcactgaacttcactcctccttcgcttatgtatggcatatggcaatcggcgcacgacacacctcgctgggcatggattccgtgttgagagatctcgaagtccggatgctgtgctttcagaatgggggcgcggctcagggtgtgaatatagtcgtaatactcagcttcatcgtaatatcgttctgcatcctccattgtcattcctttatcccatgggaaagtaaggtatttgccttctcccttaaagtagtattccacatgacattgggcgcatacgagtgagcgcatctcctgatgtgaagccttggttatatccagcccacgtctttgaaaagcttcgataagcgcggggcgggagatgtgcagatccatcgtttccggatcatggcagtctgcacaccctatcggattcactatgtcactgcccagactgctccatttgtttttatagaattcgtctactccaatggcttgcatcatgcgtggcacatcgggactcttacatacccagcacgtggcaggctgcatgtctcctgccccatcgattcccggattcccggttcgcagggtacgctgcatatcctgtatagcatgcatatgaccgcgaggagatgtataatctctggagaaggcatagccggcccagaatataaccatgttgggacgttgttccaatacgtctattgcctgactgccgttgaattccgaccggaaagatg

SEQ ID NO: 196 - DNA (genomic), 621 bp, PORYPHYROMONAS GINGIVALIS; double-stranded, circular
  misc_feature 1...621
  hypothetical: NO
  anti-sense: UNKNOWN
gggcaaaaaacggatctttctcctacaacatcttcgtataacaagtataactgaaagctgatgttatctactgaacacttcctcctctttgcttctattgtcctatttgcaggtattatggccggaaaggtgggctatcgtttcggtatccctacccttttgatctttctcttcaccggtatgctcttcggagtggatggattcggttttcagttttctaaatgcccgatgtgggcacaagtcggtaggaatcatcgctctctccattattctcttcaccggtggtatggatacgcggatcagaaaggtgcgtccggtcattgcccagggacttacgctgtctactttgggtgtcttgctgacagctcttctatccgggttctttatcttttggctgagcggttcggactttggcccttacccgttcgctctttctacctctttgctgctggctgccacgatggccagtacncgactcggcttcggtattcgccatcctccgttcgcaaaagatgcagctcaaagagaatctggctcccgacactggagatggagagcggtagtaacgacccccatggcgtatatgctgaccatcgcactcatcgatttcatcaccaccgg

SEQ ID NO: 197 - DNA (genomic), 744 bp, PORYPHYROMONAS GINGIVALIS; double-stranded, circular
  misc_feature 1...744
  hypothetical: NO
  anti-sense: UNKNOWN
cgaagaagatctgcaagccggcgaggactaccaatatgccgtggagggcagcaggctcgtcatggaacggcagcggcaggattcgctctacagggggatacaggtgcggcagatggaggagagcctccataatatgcgtcgcaatctggagatggtgcgcgcccgtgtggaagacctgaacgtgaaggcaccggccgacggtcagttggggcttttggacgtggagatagggcagacggtaggagccggcagtcgcatcggacagatcaacgtcctgtccgactacaaggtggaggctatgatagacgagcactatatcgatcgggtcaaagccggtctggccgcttcgttcgaacggcagggcagggacttctcccttcgcgttcggaaggtataccccgaagttcgggacaagcagttccgcaccgacttcatattcgacggagagcgacccgacaatatccgcacaggccaaacttactacatcaatctgcgcctcggacagccgtccgaagccatcatgatcccgcgcggagccttctatcagaataccggcggacgatggatattcgtcgttacgcccgacggcaagcgagccgttcgccgggacatcacgattgcccgtcagaatccgcagtattacgaagttacctccggcctgcattgccgncgagatggtcatcacctttcgtatgatatgtccgcgatgcataagaaattatcctgaatgacccacctatagct

SEQ ID NO: 198 - DNA (genomic), 725 bp, PORYPHYROMONAS GINGIVALIS; double-stranded, circular
  misc_feature 1...725
  hypothetical: NO
  anti-sense: UNKNOWN
gcgtcgggcatttatcaaacggcttctaaaaacacagactgatatggcgtcggcagtagccgatagcagtattttttgagaaagcgaccggaaagggaatgaactttttggccgcttttccgtttttataagcaagtagaacaagaataaactcaaacgaaacaagatgaaaaagaacatttgctcgaaagccattctcttggcttctctgctcctcctctcagtcgggacaatgactgcatcctgtacttccaagaatgacactcgtcaagaagaaaccgtctctgccgatagcaagggagagaaagatggcaaaatcatccatatcacggctgaatacatgcgcgaacacatatatgattacacagccaatccccaagaatgggtctataaaggtgataagcctgctattatcgacttctatgccgactggtgtggcccgtgccgcagcctttcgcccaaattggaagaggtggccaagaaatatgccggtaaactcaccgtctacaaagtcgatgtggacaaagaaaaagagttggcagggattttcggtgtcagaagtattccgatggttcttttcgtaccggtaaaaggaataccgacgcaaacgatgggcaatctgccgatggagaacatcgaagaggctatcgccaaatcatgcaatctgatctataggtcaaattgcagactgtaatatacctacaggccaataacactacttgagg

SEQ ID NO: 199 - DNA (genomic), 896 bp, PORYPHYROMONAS GINGIVALIS; double-stranded, circular
  misc_feature 1...896
  hypothetical: NO
  anti-sense: UNKNOWN
gccgtgtaagcgcaatagggtcaagcgtttggtcagggaggcttatcggctcaacaaacacctcctgaacgatgtcctccaagagagacagatctatgctactattgcatttatggtagtatcggatgaacttcctgactttcgtacagtggagagagcgatgcaaaagagtctgatcagaattgccggaaatgtaccttcatcggctttgaaaaacgagtaaatacgatgcgactgatcaaggcttttctcgtgcaactcttactgctccccattttcttctacaagcggtttatatcgccgcttacaccgccttcatgccggtttaccccctcatgttcgtcctatgccatcgaagccttacgtaaatatggcccgggcaaaggactattgctgagcatcaagcgtattctccgctgtcacccgtggggtggaagtggctatgaccccgttccgtaagaagttttcttcacttaattcctcttatatggtatttctcgacattcatactcattctgcagctcgcaacgatagcgagatcattcgagttcggaatctacgaccgaatgaaaccatatctccgaatactttttgctccatcggcattcatccgtggagtgtaccagagaattatagcggagagttgcttgctgtccgtgaaggattgaatcacgacgaggttgttgctctgggagaatgtgggctggataaggtgtgcagtacaccgtatgaaaagcaacgaaaagctttcctcgatcaaattgatctgagcgaagagtttggcatgccggtgctactgcacatagtacgagcatgggatgatcttttggcgatcaaaaacaggtaaagccttcacagcccgtggatcgttcatggtttcggagtagtgaaaaaca

SEQ ID NO: 200 - DNA (genomic), 581 bp, PORYPHYROMONAS GINGIVALIS; double-stranded, circular
  misc_feature 1...581
  hypothetical: NO
  anti-sense: UNKNOWN
agaagataaagacttcgcccatgccaaagaattggcagagaagtttgcaaagaaagaaggccgtcagccgcgtatcatgatcgccaaaatggggcaggacgggcatgaccgtggtgccaaagtggtcgctaccggctatgccgactgcggattcgacgtcgatatggggcctctgttccaaacaccggaagaagccgctcgtcaagctgtggaaaacgacgtccacgtgatgggcgtttcctctctggcagccggtcacaagacgctgatccctcaggtaatagcagagctggagaagctcggccgtccggatattctggtgacagccggaggtgttataccggcgcaggattacgacttcctctatcaggccggtgtcgctgccatcttcggccccggtacccccgtggcctactcggcagccaaagtgcttgagattcttttggaagaataatctctactctcgataaggagtatttcagcattctctgtatggccgctcatatgattcctcgaaagggagtcgtatgagtggcttttttatgttcgaagtcattagtgtcctaaaagtttcttcttga

SEQ ID NO: 201 - DNA (genomic), 463 bp, PORYPHYROMONAS GINGIVALIS; double-stranded, circular
  misc_feature 1...463
  hypothetical: NO
  anti-sense: UNKNOWN
ccgatgccgctacctccggttttggtcgtatagaaaggaacaaacatattgtcgaacacctcttgaggaataggagtgccattgttctccacatgaaggagtagtctgtgttcatccaacgaatcgagacgttcctcgacacgaatacgcaaaagtcgtttctccgtatcggcaggatattccgcctcggcagcatttttgacgaggtttatcagtaccgaagtcaattgccggcggtcggccgggacagtcagctccacgggtatttcttcaatatccacctttatatcgttggaggacagaagctcttcttgcaggcgcaatatccccgaaagaaaagcatgtaaagcaatgtcctccttctcgggaggaggaactgccgtaaacttacggtagtcctgtacaaaggataacagccccactccggtactacgaatggtatccaatccggtagacagcatct

SEQ ID NO: 202 - DNA (genomic), 580 bp, PORYPHYROMONAS GINGIVALIS; double-stranded, circular
  misc_feature 1...580
  hypothetical: NO
  anti-sense: UNKNOWN
ggccaaattaccttccagttcatccggacggggactgatttggctaagttcctcccctaccgacgatgaaatcgacctgctgaccaaggccctccgacgcgccggttctttcagcgtggagcctgtattggatgtccgtcaggactgggcggccgagttttattcgaatggaaaaggcgagctttacttcgttggatggtctcgtttcgatactaacaggtggggagcctatctgggcaatcgacttgccacccaaaccgatttggttgccgaactgacccaaacggtcggggcacaagcacatgaagaggctattgcatctgtgaaagattatctacgagaacgcttcgcctcactgtacaccggctatatcggagtagacatggcagtatatgccgaaagagacagtctgtttctgcatccttgtatcgagatcaatgtacgatacacaatgggggtggcagctatcctgctttacgacctttggatagagaaaggtcgaagaggtgtgttcgaagttaagggttttcgaaccgaaggcgaancacacgaatgggattcaatgatgcagtgcagccat

SEQ ID NO: 203 - DNA (genomic), 1078 bp, PORYPHYROMONAS GINGIVALIS; double-stranded, circular
  misc_feature 1...1078
  hypothetical: NO
  anti-sense: UNKNOWN
agattaataattgctggtgattacttcaggattatcttgttcgttgcagtatcgggaaatactacagcaggcttgaacaccttggcttcctccatcggcatccaggcatatgccatgatgatgatgatgtcgcccggatgaacgatgcgggcagctgctccattgagacagattacccccgaacctcttttgcccggtatggtataggtctccaagcgtgctccgttgttgttgtccacgatttggactttctctccggcgatgatgttggcagcatccatcagatcttcatcgatggtgatgctacccacatagttgaggttggcctccgtaatggttacgcggtgtattttggattttaatacttcgacgtacatgttgttttccaattctctatattttttacgattgcaaagtaacttaaaatcgctgtaatattcgcataaaatcggcagtttaacgcaattgggcttgattattaaggacatacggcgcaaactgcagaaaatccgccacctgccacgaggcagtaatatgcggattattgcgacagaaaggttttcaaatcgttacccgaaagcaaggtaatcacctccgtcaaagaggagaaaaacagcggttttccgtgcatccgttgctgttgctctactgctctatattttgcatagcagggttaggctctttcatgtttaattttgcaaccaaaaagaaaagacaatggcaagaagcacattcaaggtgctgttctatgtgaatggcagcaaggagaaagaaggtatcgtccccatcatgggacgggttacaatcaacggcacggtggctcagttcagttgcaagcgcaccatcccaaaggagttgtgggatgtgaaaggcaacagggcgaaaggcaagagcagggaagccatcgccaccaacctctcgctcgacaacatcaaggcgcaaatcatcaagcactatcagcgtctttccgaccgcgaggcgttcgtcacggcggagatggtgcgcaatgcctatcaggggctgggcagtgagtacgataccctgctgaagcgttcgacagggaatgcgcctctctgct

SEQ ID NO: 204 - DNA (genomic), 943 bp, PORYPHYROMONAS GINGIVALIS; double-stranded, circular
  misc_feature 1...943
  hypothetical: NO
  anti-sense: UNKNOWN
ggcttggagagccgtttcgaagagatttccacgcttatcacggatccggccgtaatcgcggacatgaagcgtttcacgaagttgagcaaggagtatcgcgatctggaaaagatccatacggccgggcgcgactatcgcaatctgctcgccaacatcgaggaagcaaagcataccatggccaaagagagcgacgaggagttgcgcgagatggctcgcgagatgctggccgaggctaacgaacgcttgcccattttggaggaggagatcaagatgctactcattccggccaatccggaggatgacaagaatgccatcgtggaaattcgcggaggaacggggggcgatgaggctgcactttttgccggcgacctctaccgcatgtacgtcaagtattgcgagagcaaaggctggcaggtggaggtcaccgacctgagcgaaggagctacgggtggttacaaagagatcgtcttctcggtcaagggggaaggagtgtatggtatcctgaaatatgagagcggtgtgcaccgtgtccagcgcgtacctgcgaccgagacacaggggcgcatacatacctcggcagctaccgtggctgtcttgcccgaagccgaagaagtggacgtggagatcaatccggcagacatcgagatgcagacgtcccgttcaggcggtgccggaggtcagaatgtaaacaaggtggagactaaggtgcagcttacgcacaagcctacgggtatggtggtggtttgccagcaggctcgttcgcagattgccaaccgcgaactggctatgcaaatgctgcgctccaagctctacgacatagagctgtccaagcataacgaagctattgcagcccgacgcaagacgatggtatcgaccggcgaccgttcggccaagattcgtacctacaactatccgcaaggacgggtgacggatcaccgcatca

SEQ ID NO: 205 - DNA (genomic), 2870 bp, PORYPHYROMONAS GINGIVALIS; double-stranded, circular
  misc_feature 1...2870
  hypothetical: NO
  anti-sense: UNKNOWN
attccggtggactatcacgagaaagaaggtaagagtgctctcgaagtggttttgaccgtattgcatgccggaggtaagtttgacaagggttcatacaaagtctcgggcggtttgcatggagtgggcgtttcttgtgtgaatgcactttccacatatttgcgtgcagaggtgtatcgtaatgggaagatccatatgcaggagttcagctgtggcaaacccttgcatgatgtggaggtgataggctccacggagcgtacggggacgactattcagttcaaaccggatagctctatcttctctgttacggaataccaatactccatactggccaagcgtctccgcgaactttcttatctgaatgcggggattacacttacgctgacggataaacgaacgctcaaggaagacggcagtggctacaagcaagatgtattccgttcggaagaaggattgaaggagtttgtccgtcatcttgaccgtatgaaagaaccggctggtggacaaacgttatccataatcgtcaccgagaagcagggcattcccgtgggaggtagcatgacgtataatacttcctatctggagaatgtatatagctacgtcaatgacatcaatacgatcgagggcggtacgcatttggccggattccgtcgtggacttactcgaactttgaagaaatatgccacagactccaaactcctggataaggtgaaggtggagatcaccggcgacgacttccgcgagggattgactgccgtgatcagcatcaaagtggccgaacctcagttcgaaggacagaccaagaccaagctcggtaacaatgaagtgaccggtgctgtcgatatggctgtaagcgaagcactcgaatactatctggaggagcatccgaaagaagccaaactgatcgtggacaaagtcgttttggcggcaactgctcgtcaggcagcccgtaaggcccgcgaaatggtgcagcgcaaatcgcccttgtccggtggaggattgccgggtaagcttgccgactgctcgtccaaagacccggagcagtgcgaactcttccttgtcgagggtgattcggccggcggaacggccaagcaggggcgcgaccgcgagtttcaggctatcctgccactgaggggaaagatcctcaatgtggagaaagccatgcaacacaaggtattcgaaagcgaagaaatccgcaacatatataccgctttgggtgtgacgatcggaacggaagaggacagcaaagcccttaacctttccaaacttcgctatcataaagtggtgatcatgaccgatgccgatgtggacggtagccatatcgctacgcttatccttacgttcttcttcaggaatatgcgtacgctcatagaaaacggttatgtcttcatcgctactcctcctctctacctttgcaagaaggggaaagagcaagagtattgctggacagagcagcagcgtcaagcgtttgtcgaccgttatgccgatggtaatgaaagccgtgtgcatgtacagcgttacaagggccttggtgagatgaacgaggagcagctttgggagacgacgatggatccggagaagaggacgcttcgtaaggtgacgatcgagaatgctgctgaggcagatgccatattctccatgctcatgggagacgaggtaggtccgcgcagggagtttatagaagaaaatgctacttatgcaagaatagatgcttagtcctaagaactatcagtattatcctgcggcgctccgacagctctatgaagagcttgacggtgcgccgcaagcttttgagggaggagagtctccctctcgacctgttattggtttgacagcgaattataatacctcgggctcgtgtattgccagagcctataccgagtctgtaatacgtgcgggaggtttacccttacttatccctttgactacggatatagaggtcatacgtcattatgccacgttcatcgatgggctgattctttccggtggggacgatttactcccgtcctatttgggagaagaccccattcccacactgggcgaagtcaatcccgagcgagatcggggcgaactgctattggtggcagaagccactcgccgcaatgtgccgatcctcggtatttgccgggggcatcaactccttgcgacagctttcggcggaggaatgtatcaggatatatatgcccagtcggaaaatccggtagggcataatccgaaaatccccatatcgtttgcggcacaccaagtccgtttacagggcgattccgtcttggcacgaatacttggcctaagcgatggcgagctgctgggtgtcaatagcctgcatcatcaggcagtcagcagagtgccgaaacctttccgcgtgacagccctttcttccgatggcgttatcgaggctatggaagcctatccggagaaacctatcctgtcggtacaatggcatccggagcaaatggcctatgccggtgacacccgtcagcagcaattgttcgagcatttggtcgccgaggcttctctctttgcccaagccaaagcggtacaccgctccgtaattgtgctggattcgcatgtggacacgcccatgcacttctgtccggaatttgattttacgaaaagaggaaatacactggtcgatgctccgaagatgcgagaggggcttgtcgatgcgtgtgtaatggtagcatatctgccgcaaggtgagcgagacgatgcttctctgaagcaggccacggactatgccacaggtaagctggaagctattcgctcccaagtgctctcgcatcccgagagcctgatgcaggcgactaatccggaggaggtacgagaggccaaacgtcgtggcttgtgtgccattatccccggtatagaaaacg

SEQ ID NO: 206 - DNA (genomic), 362 bp, PORYPHYROMONAS GINGIVALIS; double-stranded, circular
  misc_feature 1...362
  hypothetical: NO
  anti-sense: UNKNOWN
gagttgatctcctttggacgagacgtctcggatttcctgccggaggggtttgtcctcgattaagaaaatcaaaacaaaaagccttgcagttcagacttctgcaaggcttttttgtgtccaaaattcagccggtggtacattatcgggtcttctatgagaggaaaaaagagtgattccgaaagtagtgactctctcaataatcatacgccaaaaaagttttcaacaacgaagatgagtttggaatgattccaaataagcatctgtagagaggagaaaagccgaggtaaaagtgcagggaaaaggaactggcatagatcgaaattccacttaaaaccaagccgtacaacgatctggatataaag

SEQ ID NO: 207 - DNA (genomic), 1292 bp, PORYPHYROMONAS GINGIVALIS; double-stranded, circular
  misc_feature 1...1292
  hypothetical: NO
  anti-sense: UNKNOWN
tccccgggttggattgatttggtttcgagtatcccgatgataaattttttgcggtttggtcgagtttttagattgattcgtctattccgaattttgagagcttttcgcaccacaaaggaatttgttacctatgtttttagaatcaaagcacagggcgcatttacttcagccacgattttagccatcttattgatcattttctcttccatagcgattcttcaagtcgaaaatgcgtcgaccagcaatatcacaacagcggaagatgctatttggtggtcttacgttacgatcacaactgtcggctatggagacaaataccccgtaacaaccgaaggaagaatcattgcaatgtttttgatgactgcaggagtagggcttttcggaacttttacagcctatattgcttccttatttgtctcagataacaaaaaagaagaaacagaaacaaaagaatgattgtcaatcttattgctgctgttgcctgatattgagcagaataacagctgataccgcttccacttaattccactcatgaactctattatcaaatagatggttgtacagcgaaaggggcaaattgtattcttttccgattggaggagatagattgacaccaatgcattgtttagattctaatctgttttgaaggtataagattcccgattaaatacattggcagtgctaaaaaaacaaatccctcagtaaggcggtcggccttgctgagggattgttataattgtcctaaggacagtataacgctttagtaggaggagtagggcgagagttttattgctcgggggcaaacatgggatcccatgcgggcaggcgtatgggcgtggtcttcaggatgtcgagcaccttggccggtacatacctcttgtttacaaccaaacggaatgtataggcatcgaaccattcgtcagtgatgatcaggtgaccctgtgcaccgttgttggctccccaactgttctctaccatccatttggtgggcttgccgttcgcgtccagatccactgccataagtgtcatggcgtgcgtagaaccactatcgaatgtctgtatgcgttccttcttgttgagcgtgaactcttcgccgagcagtgaggcatagtcgttattgtccatagccaatatgccacgagtacgatccaactccttaccaacatcgcaagagtagtacatcatggtgctgtccttgatggatgcgatagccatctgcttgaggtcttccatcggtacattcacgtatgtccagttcttgccgtcgtagttgtggcggtcgnagtcgaggg

SEQ ID NO: 208 - DNA (genomic), 2288 bp, PORYPHYROMONAS GINGIVALIS; double-stranded, circular
  misc_feature 1...2288
  hypothetical: NO
  anti-sense: UNKNOWN
ccaaatgaattcatatatgaatttctccaactatttctatttctcttcacggttcagtaaatatcttctatgcaaaaggcgtattttagttcgcaaagttactcatttataataagaaaggcaaataaaacggcaagaaaacgcctcttgcgagcataaaaatgtcgcaagaggtgtatgtggtaatcagggtacataaaacagggcaaactccacctttcgtcgtttgacgagacctctgaggactttgcccttgtatcggcagaaagagacaaattcacgatagaaattcctgtcgcccgactctatcttccgcaacagtcggctcttgggatgcttgccgtatccgagcaacctgcctgtcccgacattgtaggaaaggacggcaagcagaagaacagttccatttaaaacatctgaagatagggatttacaatagcttcctaaatttcatctccgccaatctgttgatttcatccttgtagatttcaaggtgatggaggatgatgttctccacatagataccgatggtcatatccctgtttctcatcgacatgactatctccgccaacgtgtcttgcaactctttggcaatatagatggtcttgcgatttttcaaggtgttgcgacagatgaaaagcgactcataatcacctttatcagcctttcgcctttctcttcttgggactcttgaaaaatcctttgacattggttcttcatttggacgttccgattcaacacactgctcttctaattgagagcgttttatttcgctctcatttcttttcatgggaataccctgtgaaacaagttcccggatggcaacaggatctaccttgccgttttggttctctgtcatactttcttaatttttattattacacaattcattgttcatttcgttgccagtatatttaccgatgaagatgaatacatccgctatcgaagatatgcccaataatcggcttgtaccagtagggctacatcctttcattcataccctttctgtggagatgttcattagtgtccatcaatacaatcgttcgattgtatctgccttcgcacattcccacgttcgagtgaaagaatcaaggacatgttctttgacatacaccctcgcctatatcgctcatcgaaacgtgatgttatcgaagacacataccatcaccgacatattcgacagtgcaaatatatggttcggtgatgctgtaatcagcgtgatttcctttagtgcgtacttgtggcatcgatttggataattgtggcttcgttctacctaatagctttgggtacaagagatcgtaactttgcagtaagcgataagtcggtatttcatggcttgggaaacatacatttcgagagaataacatatcgttcttcggaacgaatttatttgcgtcagtgcaaatagcaaggtatgtcttgcgttacccgaaattatttcggtaactcaaaacccttgctcttgcagagggcagaacacctccgaagtcggtgttcttggatagaagttttcgttgtcttgattggctattttatcgtgaacgctctctaatggatttcaattgtgtttagcacgttctatttccagaagagagaattacaaaccattaaaatccaaagtaatgacaaagagaaatgtgggacgacctcccaagaatgaacgagccgaccattgttgtatggttcgatttacggacacagaatttgctcgtttcctaacgctattcgagcaatcggggcttcaaaatagagccgctttcatcaaggcaagggtctttaatgagacctttcgagtgataaaagtggatcgttcgttgctcgattactaccaaaaactgacaactttgtacggacaatttcgcagtgtcggggtgaattataaccaaactgtagtcgctttgaaaagcaattttacggagaagaaagcctttgcgatgctcactaagttggagaaactgacactcgaattagctattattggaggggaaatcgtacaactcactcgtaaatttcaagagaaatggcaacatcggcaatagacatattatatcatattgctccttgcatggatgtaaaaatcagacttcccttttatttgaggaagcctgattaaccaatgcgattatcgctttttgaacttgccgcctttcagatcgctttccaccatacgcttattaagtttctcacggagttcatcaagaaaataggtgcggctatcatctttgcgacgtttcatgttcatatagacgttgtagctgttctttatcgccactccgaagatctcc

SEQ ID NO: 209 - DNA (genomic), 887 bp, PORYPHYROMONAS GINGIVALIS; double-stranded, circular
  misc_feature 1...887
  hypothetical: NO
  anti-sense: UNKNOWN
ggcaaagctggaggagctatctgcatctctcccgatcgttgaggggctgtcttcgttgatgcgcaaattcaaggagcaaggtattcgctctgccattatttcgggaggattccgactttattcgcacaacatcaaagagcggtacggcttcgactacatctgcacatcggaggcagaggtggaaaatggcctgctgacaggtcgtctatcgggtaccatagtggatgcgaaggtcaaagccgaatttctccgctccctggccaaggagctatccctcacccctgccgaaataattgccgtaggcgatggagccaatgatgtacccatgcttgacttctcggccggcagcatcatattcaacagttcggcacatccgccttccatgcctcaactacgcatagaagccattctccaattcatgggttgccgatagtcgccgacccgatccgtatagaataagaacctccgtgctaagagaaatttatcgtacggaggtatgctttttggcggaaatatatttactttgggatagaagagtagacccataaggagcttgaatacgatgcgatcgtatccgaagggcatgcgaaatatagatcgggaaaggtgcccgtattctttggttttgcgagcttcttttttgactttcccgtggagtttttcccctgatgtatggccgaagaggaagcattcgtgcctcttcagggcatagggacaaaatttttaagaatacaattatcagatttatcacaatgaaagtaggtttgttcatcccctgttatgtcaatgcagtgtatccggaagtgggtatcgccacgtacaaactgctgaagagtttggacatagatgtcgactacccgatggatcagacatgttgcggccagcct

SEQ ID NO: 210 - DNA (genomic), 718 bp, PORYPHYROMONAS GINGIVALIS; double-stranded, circular
  misc_feature 1...718
  hypothetical: NO
  anti-sense: UNKNOWN
gtcgttactgtttgcaggatactctccctatcgtatctctctattgatttagagtgcgttccgagaatgagtttaatctatttttcgtggggcaagatacgaatttttcaattccagcagtctttcccctcttctttctgcctttcagcccgagagcctcgaaacaggcaaaaggataaaggatgcgcgacgaagtatctctacaaagttccagaaaatgatcaccgtcgggactgcatatcgaatagctgaccctgtgcgcttataacggatcagacgagcaaaaagataaagggtacagaacaaaggaccgaaagcaacgacgtaggccacagggtgcctatccccccaataaagcattgtcatagacaaacagcaagaggagatagcacgtccataaaacggtatttgctccataaaggtggtgacagccacattgcgaacgacaggcatgaaagagcgaatctgctcacagcggagcacgtgtcgttgtacccaattgaagagattgcatcccgtacgggagctgagcagatagccaatcatcaccgccaaggaaccctcaccggatggcataatgaatatgcaagagaagaaaaaaaaccgtgaatttgtagtttgtgactaagagacttcccggcctttctacgttcgctctgtccgaatgcccatgaaccactctgctacagccggatggccataggcagggatgaattca

SEQ ID NO: 211 - DNA (genomic), 496 bp, PORYPHYROMONAS GINGIVALIS; double-stranded, circular
  misc_feature 1...496
  hypothetical: NO
  anti-sense: UNKNOWN
ccccgggaataggcggattttcgccggctatcgtactgtatctgctgatggctatcgtagccaagcgtacaggctgcgagcagaagtgaagctaaaatcatgctccgctctcctttcctctcttcttcatcacaaccaaaaagcaccatcataatatggaactaataggcactttttttcttatcctgctaatctattgggtaatccgatttctgattcggatgttcgccattcgtcagatgtttttcgaacagaagaagaactcttcacgacaaggaacagaaacctcaaaaaacccttctccgggtgaaaaagtcgaactcgacgaacttgaaaagcgaaaatttgacaaagaccaaggagaataccgtagacttcgaagacataaaggacaagagctgatgcangaaccggatggatccatatattcagcagactcggatccttttgctccgatatcaccctgtccgcttggataccggatccgacatataat

SEQ ID NO: 212 - DNA (genomic), 2547 bp, PORYPHYROMONAS GINGIVALIS; double-stranded, circular
  misc_feature 1...2547
  hypothetical: NO
  anti-sense: UNKNOWN
tctgcatcatcttttctcctctctgcatttatcctgcctgctctcggacaaaaatccaagcaggtacagcgacttgagaagcaacgtaaggaggccctcaaagccatcgaaaaaaccgatcgcgaactacgaaataccaagaaagacaagcaagacaaacaaaagcatctcaacctcctgaacaagcaggttgctcaacgcaagcagatggtacaactcttggacaatgaggtcaaagagttgcaatccgacattgattccatgacgggtgtatgtcatcagctctctgtagaagagaaagcccgatccgatgaatatgcccaagctctacagtctatgcaaaagcggaaacgctcgttggatcgcatccttttcatttcatcggccaagagctttgacgaaggcatgcgacggatgcgtttcttggaacaatacgcttctgcatacaagctggcatctgtccggctgcgcgatacacgtagcaagttggagactgaacgtgcgactgtagaagacgccaaaaaggagaaaggacatctcttagtcatcagagaagaggaaaaaaagaaactcgaaggacagcaagccgagcaacgtcggcaggtgcaggctttgggagccaaacaaaaagacttggaagcgcagctgcgaaagcagaaaaagcaagccgaagctctgaacagaaagatcgagaaacagattgccaaggaaatagaagctgccgaacgtcgtgctcgagaagaacgtgaacggttggcacgcgaagccaaagccaagggtaagccggttcctgccgaaccggaacggaaggcggagaccaaaggcggctatgctatggatgcctctgagcgtgctctctcgggcagctttgcacagaacaaaggtcgcctgcccggccccgttcgcggcagataccgaatcgtaagcgactttggcgtgcatcagcacagtgagctgaaaaaagtacaagttaataatggaggtatcgacatcgctgtagcaacaggatccgatgctaccagcgtattcgatggtgtagtgtccagtgtattcgtgatacccggttataattcggccgtaatggttcgtcacggtaactatatcacggtttatgcgaatctgagcaaagtgtatgtaaattccggcactcgtgttaaaacgggtcaggctcttggtcgtgcctatacggatccttccaacaaccagaccattattcacttcgaaatctggaaagaacgcagcaaacaaaacccaagactatggttacgatagccattcccaacgactataataccccatttcgagatcttccctggattccgaaagtggctgctacgatcggtacattcgatggcatacacttcgggcatcgctttcttctcgatcagctcaaaaagatggcgaaagagaagcatctgcctactatggtaataaccttcgacgtccctcccatatcagtggttcgcccgggaacaccctaccagaagctgactacaataggcgaaaaactcctcagacttgaagcggaaggagtagactatacagtggtgctgccttttacacccgaattagtagcaatgacggccgacactttcattacaaccatcctgcacaaacgactccatgtaaaagccttgctcattggctatgatcaccgattcggacatggacgcatatccggtttggaagaatacaaacagatagctactccattgggtataacggtaaagaaagcttcgcaggctgagatcggtggagtgccggccagctccagtgccgtacgccaagccctgatagacaataatcttgctttggccaatcagctattggggtatgactatatattgacgggaaaggtggagcatggttttaggattgggcgcgaattgggattcccgacggccaatctgactgtaagcgacagtcacaagttgatcccctgcgatggggtctatgccgtcagagccattgtaagtggcgaacgatacaatggcatgttgtatataggtcgcaggccgacgttgaacaacggtgaccagcgaacgatcgaagtcaatctcttcgaatttgataaaactatctacggatctcagatacgagtggagtttgtatcctttatcagagaggatatgaagttcgatagtttggaagctcttcgtcaacaaatacaagccgactacggccggatctcagctctcttcgagtccgagcaatccgagtactctgagtaatcagaatactctgagtactcagagaataagctcctacaaattctttagtagcgtgtccgcaggggggatgtgcaggctctgacgggaatcctctatcgcttgccattcgggagcgaatcggaccttattgtctaccttgaagtgttcgctcccataacgatctatacgatcgagaatgaagcccaccgttattttctcgggatctatcgctggactgaaaaattcggccttgggatcgtgtgcataattcacttccgttatggcttcgatggaaagcaggcggtgtatggcttctgacactaatcggatcggagct

SEQ ID NO: 213 - DNA (genomic), 586 bp, PORYPHYROMONAS GINGIVALIS; double-stranded, circular
  misc_feature 1...586
  hypothetical: NO
  anti-sense: UNKNOWN
ggctgtgttgtccggctgtcctgtctttttgaatttgaccatgatgaagaattccggtcgcttctccggtgtggagagtgtccatttgttatagtaagaatagaaatggatagaattggcaggtgccgactctgcaatatcaagatattccgatgtcttataggatgcagcagctgggatctcttgagcttctgtggtaaggaaccccttcgttaccgaattgcgaaactttgcctgtatatttccgaccacttcatatccttgcacattgatggtgggttttatcatgcgaatctttgctgccactcgtttgagtttataatcccccaacagtttcccttctgtcgtagccatattgatctgcttattgccatgagcaagcattacgaaatcggcaggggctgtcgtagaagagacttcaatagatttctctaccacaaattgagaaagcgcagcttctgtggccggagcattgaaatcgagattggccactacatagatgctgaagttgttgttgccattgaatagtggtcgcatttgctctttgaccggaatgatatangccccttcatggatttgatagtct

SEQ ID NO: 214 - DNA (genomic), 392 bp, PORYPHYROMONAS GINGIVALIS; double-stranded, circular
  misc_feature 1...392
  hypothetical: NO
  anti-sense: UNKNOWN
gggaaggcgtaatgaagaaagaaattctttcagcagattacaaaggcgaagttgttcgtcattctgtagctgattatgtcaaagccgaagacttcgctgtaaacattattgagcgtcatatagaagcaagcaaatccaacctcaaggcttcacccattgtcgttgccggtggctacggagtcggaagcaaggaaaattttgccctcttgcatgatcttgcatctgtattgggtggagaagttggagcttctcgtgctgcggtagatgctggttttgccgatcatgacatgcaaatcggacagacaggcattaccgttcgtcccaagctctatatcgcttgcggngtcagcggacaaatccagcacatcgccggtatgccaggganagctcta

SEQ ID NO: 215 - DNA (genomic), 987 bp, PORYPHYROMONAS GINGIVALIS; double-stranded, circular
  misc_feature 1...987
  hypothetical: NO
  anti-sense: UNKNOWN
cggataagttggcacgggctacatcgacatggataaatatcttcaggacatcgtacgggacnaancgatactgggagactaagcggtaccaattatccgaaaggagnaaaancggctggaaagggnctgccgccgaatatgaatcgcgtctggagtctatcaaaaaagaacgcaaacaaatactggacgaagcccgccaacaagcatccgtgatgctgtcccaatcgtctgcacagatagagaaatcaatccgcgacatcaaagaggcacaagccgaaagggagaaaacgcggagagcacgacaggagctgaacgacttcagggaaacgatcaacaaagaagagatcgaaaaagaagagcgaatcaatcgggagatagagaaaataaaacggaggaaaaaacggaagcaggagaaagcagcaagccgttcggccgaaacacctgtacagccaaagctgcaagaagtgccccaaccccctgtcatacaagtgggcgatacggtacgaatcaaaggacagacggctataggcagtattatagatatgaatgatcgggaggctaccattgctctcggaatgatcaaaacgactgtgccgatcgatcggttggaaccggccaagcccgtcaaggagcggaagtctgagcctgtctccggggcatctgcccgaatgatcatagaccggatccacgagaagcgtttggatttcaagcaagacatcgatttgcgtggcatgcgtgtgaacgaagccgtccaagccgtcatgtattttatcgatgatgccatccaactgggaataccgcgcgtacggatacttcatggaacgggaacaggtgcactcagaacggtgatcagggagtatttggccacagtcaatggcgtaaggcattttgcagacgaacacgtccagttcggaggagccggcatcactgtcgttgaattgggatgatagctttcgatacgatcccaaatggctgaaatcatctgct

SEQ ID NO: 216 - DNA (genomic), 533 bp, PORYPHYROMONAS GINGIVALIS; double-stranded, circular
  misc_feature 1...533
  hypothetical: NO
  anti-sense: UNKNOWN
ggccaaatcctgctgtacgatcttttcatttttcgcagccagttcggcccgaagagacgaaatttcgttttgctgcttttccaccagctccatcagcttgcggacgttatactccagcttcgaaagatcgagttcctcttctccggtcatagaataatccttttccttacaaaagtaaattatccgcgccaaactggcaactaattttgtgtacttgtataaagagtaaataagacagtcattacggagaaaaaagatttggttatttttgtcttcacagaaaggctgctctgcataatggcttctctatattcaaggagccggtaatgaattgaaaaagagaagattgaatagaattgcaaaacatagaaatgctaccactcatgacccaccgcctcacatcaatcggaatatcctcttcgatcggatatgctgcagcgatagacctcgatcccggtcgggattgtagagaacgaatccatcagatatgcaaatcatagatcgaccgatagcatcatagcataggacaagct

SEQ ID NO: 217 - DNA (genomic), 408 bp, PORYPHYROMONAS GINGIVALIS; double-stranded, circular
  misc_feature 1...408
  hypothetical: NO
  anti-sense: UNKNOWN
ggcataaacctccagcatccgtctggcttcttcttcggcttcctcttttgtagcatgagccgtatgcccttcttgccaaaggaattcggctgtccggaggaaaagacgtgtacgcatttcccatcgaactacattggcccactgattgcagaggataggcagatcacggtggctttgtatccagttcttatatgtattccaaatgatggtctccgatgtcggacgtacgatcagctcttcttccaacttggcttgcggatccactactacgccgtctccatcgggattggctttgagccgatagtgagttaccacggcgcattccttagcaaagccttccacatgtnctgcttcacggctcaggangctcttcgggataaaaagagggaaataggcattgaccgtgtc

SEQ ID NO: 218 - DNA (genomic), 484 bp, PORYPHYROMONAS GINGIVALIS; double-stranded, circular
  misc_feature 1...484
  hypothetical: NO
  anti-sense: UNKNOWN
tgatgtccgtgatgatgtgcctcatgttcatgtttgtgctccgagcaacaggcgtgggcgtgagattgttttgtttccatagatttgtctcctacacattatgatctgatgtttttgttttgacggcgtgtcataatgagcaatttgctgcgttgcctgcgacattcggcttcagtcacgtacttcagtacgttcctttcagactctgttttagcacctttgtgctccaaaagaattttgacactgctccatctttattgcaaatgtcatcattttgtcgacatttttaccatatatttcgccgtttcaaaaagtataacccttgatttcaggaaattcatcatgcggcgtaaagatcgagaaatgagccgagaattcggtttggaggtaattaatcgggcagcctacggtgtcctttctgtcgtggattcggacggtgcaccctatgctttgcctcttttcatcgtgcgcgatggggagaatt

SEQ ID NO: 219 - DNA (genomic), 1744 bp, PORYPHYROMONAS GINGIVALIS; double-stranded, circular
  misc_feature 1...1744
  hypothetical: NO
  anti-sense: UNKNOWN
caaaacagaaaaactatactacctttgttacctaaacattgcgatacccaatcatgaataactttttcaaaatacacgacaacttgctacgcaacctatccccttcgctgcgtaggggattgatggacgagatcgattggaacgatagactgatcggtatcaagggtgcacgaggcatgggaaaaaccacattcctcctcgactatgcacgcgaaaacttcggtataggcaatagaaaatgcctgtatatcaatctgaatcaactctatttcaccacagaatctttggtgaacttcgccggtgagtttgtcaagcaaggaggagaggtactgctacttgaccaagtattcaaatatcccaattggtctatagagctgcgtcagtgtatggagctatacccggacttacgcattgtctttacggggtctacggtgatgcgcctgaaagaagaaaatcccgagctgaacggactggttacatcgtacgttctgaacggtttttcattccgcgaatttctcaatctcaaaacagggctgtcgcttcagccttacagcttcgatgagattgtatccaaccacgaacagatagctccgcgaatcctcgagcaggtgaaccctctcgactggtttcaggactatcttcaccatggatactaccccatattcctggaggataagaactattcggagagtctgctgaaaacgctcaatatgacgcttgaagtagatgtgcttttcatccgacagatcgagcagcgattcctgcacaaactgcgcaagctactctacctactgggacaacgtgctcccggctcgctcaatatatcgagcattgcgaaggaagtggacacttctcgtacgacgataaccaactatctgaagtacctgtccgaagccagactgatcaaggagcttcaccgcgaagaggagacgggtgccaagaagccggctatgatctatctggacaataccaatgtgggatacgtaatccagccggaacctctcaactatatagacgtactcaaaacattcttcctcaatcaggtcaagagtcgcaacgaagtatgtttgggatctcgctctcaaatcgcattctgcgtgaatcgccaatatcagttctgcatcgatgagaagatgagccgtcgctacagacccgaccgctactatgccatccagaacatgcgcagcggtacgcgcaacatgatccccctctggctcttcggattcctgtactaaaaaaacaggacaacgaactgtgaaagccgatcggggcgttcggcttgtcctcactttgctctgattccttagtgagcagacaaagaatatggacaaagccgatgcatccgcaacgaccgactctgtttcagggttgctatttcagaatacaagaccgaaattattactttttataactaaaaaccaaaatggctaaagaaaaaaaattcctaacttgtgacgggaaccaagccgctgcgcatattgcttatatgttcagcgaagtggctgccatttatccgattacaccttcgtctacaatggctgagtatgtggacgattgggctgctgccggccgtaaaaacattttcggcgaaacggtaagagtccaggagatgcaaagtgaagccggtgcagccggtgcagttcacggctcgttgcagggaggagcactaaccacaacctttacggcatcacagggcctattgctcatgattccgaatatgtacaaattgcgggagagttgctac

SEQ ID NO: 220 - DNA (genomic), 473 bp, PORYPHYROMONAS GINGIVALIS; double-stranded, circular
  misc_feature 1...473
  hypothetical: NO
  anti-sense: UNKNOWN
gaaataacatttccaaatggagaactgattaaggacaaaaagatccggatggaagattataagatgaaattcaagaatctaatttatactgttccagaaaacagaaagcacctatcttaccaaacaaaatctttcgatacaaaaaagaaagatgagcctatgcaaagatgaggatcatgatttgtgcgaagatgatacggacgaacatcgaaagcggatacacggtggcgtacaccacagaggctccgtcacctttgagctggctattcacatagtcgagagccatcggattggccgtacttccgcatatcataccggctgtgccatcgtacctgttgcggagcaacttgatagaagcccaaccgaccaatagcgtaggaagcatcgtaatcaaaaagcccgctccgacccaaagcagaccgtccccatggataatggtatcaaagaaattggctcactggccaatccagtcc

SEQ ID NO: 221 - DNA (genomic), 645 bp, PORYPHYROMONAS GINGIVALIS; double-stranded, circular
  misc_feature 1...645
  hypothetical: NO
  anti-sense: UNKNOWN
gcattaccccctttcagaaaaaagtactcgctcggatagataaccgaccgatcgaaataacctccgacattcaattgatagaacagtgacgatgccggtgaaaagacaagccgctgctgtatgctcaaatcgaggtggtggaaacgtgcatcggacttacgccccatcccgaaagctccgcgataagagagagaaaggagcggagcacgtatgccctcaccctcacgaatgagaaatccatccgccgtataacggtaataaggacgcggattgaatgtcatcttagctcgtacttccagcaatcggtgatgaggaactatgcgaggaagatcgggatcggcattgctgatattcagaatatcggtaatactgccaccgaagagactccacgtctctccatgcggcaaaggattgcgctcggccagcatcacgcttgtctccacattgagtttgggcaataggtcgatactattggtcagacggacaaatttatcatcgtagcgagttgtcgggccttgtccgttgagcagctccatcatcagatcggtcagttggtctattctttcgcgcgtgctgtacaaatcgaaagagcgatgtcctgcggataattgcaaaagccctctttgcggaggagaatagtacagt

SEQ ID NO: 222 - DNA (genomic), 801 bp, PORYPHYROMONAS GINGIVALIS; double-stranded, circular
  misc_feature 1...801
  hypothetical: NO
  anti-sense: UNKNOWN
tgcgaatatgaacaaagaaatcacttttgataagctacccgaagcggtaacgtatctgaccgaacaggtctccgccattaaagaaatggtatcagcattgcaccctcctgtgcctgaagaaaaatctctcataggcatagacgaagcgtgcgtaattattcagaaagctaaacctaccatctatgctttggtacgcaagggaattgtccctgcatataagcgtggcaagaaactctacttctacaaagaagagttactacaatgggtagagtctggacgaaagggtgcaactacagccatatcatntgaggagcaactggccatgatgcgtcaagaggtgcgtcgtaaaccgaaatctatcaagtaacgatgggccatggaagaagaagctatcgttccagaagtccttcttgacaaagcaatagagttgggcttgtcgttcacgggttcgacctttcctatcagcatatttccctctgagatacgaaacatcattgcagaggtacatgagtgccaaggttttcccatcgattacatcgcctctgccatgcttgtggcaattgctgtggggataggaaatactcatcttgccgaactcaaacgcggctggcaggaaagtacgatgctctatgtcgcattggtcggacgtccagggacaaataagagtcatccgctaagctttgcgatgaagccttttcttgattttgactatcaggaaaacaaactatacgaacgctcctatgccgaatatgacaacatcatgcgtatgaatcgtaaggagcgaatagagggaggcttccc

SEQ ID NO: 223 - DNA (genomic), 613 bp, PORYPHYROMONAS GINGIVALIS; double-stranded, circular
  misc_feature 1...613
  hypothetical: NO
  anti-sense: UNKNOWN
ggaagcagttggaggacatgcagggataagggctgtggaaatgatgaaactccgctttgacaagcggcttgatgagaacacgatgaaggtgtattgtattgattatcatattattgaaaaagtactcatcaattcatcagaaatttcatcactccgacttcggtgggaaacggcagtggcattacaggcggaaacggaacaggcagaacacgctgatataagcagtagaaaaggtagtcacggcaagccgtgcattctgtatttccaagtatgcagggggttcagacattcgggtgcagtccaagtatgccttcggagaaacaagtccaatcggcagcaccgatggagaagccgtggggacttcagaatacaagggaaagaagtggctggggcaaatgcccacgtggtaagcacggtacggatattttcaaaagagaaaataccgtagctcattaggggattttnctcacgcttcactccgtgtccgntgaaaatctcccaataagccaacggggttgcacccctctggacacccctgccgagcctgttggcatgaaggaacgggcaagctgaaacaagtttcattttccctctcaccgataaaatcaggaat

SEQ ID NO: 224 - DNA (genomic), 1135 bp, PORYPHYROMONAS GINGIVALIS; double-stranded, circular
  misc_feature 1...1135
  hypothetical: NO
  anti-sense: UNKNOWN
gggaacaagcgagttctcatcacgggagcaacgggcttcatcggcggctatctggtcgatgaagccctgcgccgtcaatatgaagtgtgggcggctgtgcgtccccacagcgatcgctcacgcctgacagacagccggatccgatttgtagagatcgactaccgcgacccgtccgatattgctcgcttggctgataagatagctcccgaaggtgaatccgcatggcacttggttatccacaacgccggtataaccaaagctcgtgacacctcgcttttnagagagatcaatgcagagcagaccaagcgttttctgataggattacaaggggcgaagcactgccccgaacgctttgtcctgatgagcagtatgggtagctatggagctcctcccgacgactgccaaccactttcctcctcttccgtacccaaacctacgactgcctatggagagagcaagttgctggcggagcaatatgtgcaaacctttgtcacaataccctataccataatacaacccacaggagtctatggacctcatgaccaagactatctgatggcaatccgcagcgtcgacaagggattcgatttctccacgggtaatacgccgcaaacactgacttttatttacgcagaggatctggcctcagcagttttcatcgcagccgaacaccccgatgcagcagggcagaagtatatagtatcggatggaaaagaatacaccgatatagagttcggacgaatgatccaacacctgctcgacagaaaaaacgtatgccatttgcgtattcctctgcctttagtaaaagccacctgctatatcggccaaaaatgggcagacatcagtggcacattgacaccgcttaacctcgataaatacgccatcatagcccaacgcaactggcggtgcgactcttctccgatcagggcaatcggtttttctcctcgctataatctggagcaaggtttggccgagaccattcgttgggcacgtaccaccggacaaatccgtcgttaggagacattccggttccttccgccgaccgtatcggatgttatcgctatccggtcaatccaatctttcgaggtacttcttacttcctggactttaacattaacgtcaggtttgaccgtaa

SEQ ID NO: 225 - DNA (genomic), 2572 bp, PORYPHYROMONAS GINGIVALIS; double-stranded, circular
  misc_feature 1...2572
  hypothetical: NO
  anti-sense: UNKNOWN
cggccttcgggaatcgccttactcattccccggtaaaacgctccgcctgaaagaggatgaccggccggtaaagtggcagtcgtatcctgcgcaagggctgtcgctccgatagtcgtaagcaggacagccgataaagtccattttttcatgatcgtcgatagattgattgttttactttgtctgtactaaaaagagtcggtacccgcctttgagcgtcacttttacggtgcggagtttcttttgcaggagctgactcgctccctgcatcaccccgcgggccgcttcggaaaggatctggtctttggcggaggaagcaaaggtgaacgaagtcccgaccgttcctcccatattggctcccacttctttcagcgcggagacctcttccgatccgggaataaaaactccttcctgtccgtccgtatcgaaggcggagagctgaacggaaacgatccgtccgccatactcgatactcgtgatatgaagcttcatccggttgccgtcgattcgggcctgtgccatcagtcgggtatgacggggaatggaaaggtcgtgcaggcgagcggactccagcagacggagttgtacgaagtctccatgctgcagggtggttgtcctgtccacgaccacccgcaacgtattacgggtgacggacgatgccggcacgtcggcagaccggaaaccgaagtttcgctccttatgcccgtactcggcgataaaagccgaatcgctcatgggctgatccagagacgaaacgattgctttcttctccggaagaagctccacagcgggtaaagccgcccgttctgctgtcaccgctgtcttgggtgcgggagcatcggccgggcgttcctgactccgggtgtatgcatcccgggaatttgcatcaccggaggccgggaagtatttggctgccatccggtaagatttttcgagcagttcgagatgatcgatctcctcctctttttcctccttgagagttgcgagttcggagcgtatcatgtccagctcttcccgcagggcttctttctcatagtcgtatgccggtggctcgtagaatgaatgtaccatctgcgacgtttcttcataccggcttaccgaccgctcgatcggatgaagcccgtccgaagcggcctcttccgagatttcctgctcccgtgtttcgtctttcttctcgaaatagtcgtagaggttgccgagggtctcctgccggtgggattccttttcttcatcgcgccccagttcatagcctttcagtttatcgtcgggcagttccccgtcggtggcttgcggaacggtttcgttaagacctgctgtcctctcttccttttgtcgctcttcggccgaaggagagaagatcagccataaggaaatcaggaagaggatgcctaatccggcgaagacaagcagttttttaagctgttctttcttcttttcggactgttctcttttttctttctcttctttgtccgctccctttcccggggtctccggaaaaacgggatgcggatgtttcggatgtttttcattgttcatattcgatcgtattaaggtaatttttggcgtaatgcttttgcggaagtcgctccggccgaaggctgtccgtgcgaacgggactgtcgatcagctcgcggaatcttttttcttccaccggtctgtaatcggacggagcaaagaaccggacaatcataccgagcgaacagcacagataaatcaggctcagcccgaataccgcgatttttcgttgcagggggcttaaacggtcacattgccgctttaggccgaggtgtattttcagatagaaccgtttcantcgtttcacggtttgaatgtcctgattttgcagcacggtaaaacgttccaacaggaaaccctgcggattgttgtccgaacgaacggaattgatcaggctgcattcggtgataagcgaccgctccgtgatgttgctctggcggacgataaactgccgggcgtaagtcctgacccgataaggataggcctcgaaatcgcaccggatggagtcgagctcgatacgctggtggatattgcctgaaatcatccggctgtaatatcctttttccatcaggtctttgtagtaattgtaggccgttttgtcggccagcatcaaagcgcgtttgacattcccttcgatggccgccttgtccggcgcaatcgtaaagaagagttcgtgaaaacgcctgacgtgctcgcgggcttccacgggacggttggctttggcatcctggctgagagcgagcataagcgactttccgttgtccagcacatagactttctcccgctgtttttctgcaaaggaataggatgaaaaaacggcatagcccgtgataatgaggcagagtacgacaaaggcaatggcataaagccggatctgccggaacgatgtttcgatatttttcaatgatttgaattccataaagtaaggtgttagctgttcgttgttttaggttgtttcgtcaatgctccgttggtgtttccaccgccggaatcgccttcggaggaacctttccggaatcgcttcctgaaacgtnccaaagcattacccgacaactgcgcc

SEQ ID NO: 226 - DNA (genomic), 413 bp, PORYPHYROMONAS GINGIVALIS; double-stranded, circular
  misc_feature 1...413
  hypothetical: NO
  anti-sense: UNKNOWN
ccttcagcagcaaatcgaagttcggagcagagaaaagcaccttgccggccatcgcatcgtcaaagttttccaatgccgactttacatccgcttcggaatagttgatcccctctttgactttgaagatctgaatcgggaagatgggtacttcaccatgccccaaaccttcctccgtggcacgtaacaactcctccatcaccattcgaccttcgggcgaagtatcagtgccgtaattgatggaactgaatacaacctgattgcctccacgagagtgcatcgtattcaagttgtggatgaagccttccatagcctgatgcgtatccttacgcgtctttcggaaaactgtggcaagagcgatctccacctctgtactcgaaaaagggaaagacgccgcacatcagtccctcatataa

SEQ ID NO: 227 - DNA (genomic), 468 bp, PORYPHYROMONAS GINGIVALIS; double-stranded, circular
  misc_feature 1...468
  hypothetical: NO
  anti-sense: UNKNOWN
taaaaggactcttaagggacgactaaatatgcttttcaatacgcccatgatctttctctattgtttcccaagaatgaagcttatatttccctgaaaacgcatcttggacatcttcaaacaaatacttctgattagctttgaggctaagaatatagtcggcctctgattgaataatcacttcagcaatagctgtttgtattcccattgcatcaatactaacaactgatccacttaaatcaagactatccggtacttcgggaatagcttgtaattcattgtgtttgtctgtaactgtctcttgacaagacttaagctcacttgatcaatccatgccgagagtatatatgtacacccagtcttctttgggagctacgcaaacgcttgccatctatggcaatatgtttaccctctaaatcgctaatcaagtcttttccataaacactgagacaagcgtaaagagcaatgang

SEQ ID NO: 228 - DNA (genomic), 664 bp, PORYPHYROMONAS GINGIVALIS; double-stranded, circular
  misc_feature 1...664
  hypothetical: NO
  anti-sense: UNKNOWN
agagtttatcatcaacctgcaaacctgacactctccattatcctttgcgccaataatgagatagccattcttgccactaccgaaatatcatttgagaaagcacatatcgcctgacaaaacttatccatattgccagttgattctcaatattatagctctcagtgtccgagagcatttgtagaagttcctttttcgttatcatttatctctatttatcttcattcgtatcggataatatttgctcataaattcaacaccctaatgtcaaacatataatacattcagaaaactttgtgtttcacttacaaactaaattggttttgacaaggaggtttatatctccttgtgagagacagttatattatttctttgtatttatcatacttattcccagtgtttgatacacattctctaaacattgacgaacaaaattgaggttctcatgcgagcagtttaactctgagaagagcagctgttgaaaaccttgaataatctcattacttaaagggccatttttgaatatattaatgaatatattttttatctcaatctctttttgattagtatcaagttgtgtttgtacaatcatatccactaatcttacacatggcatagcagaaaccatactggatattttctaagcaattagtataataattatctt

SEQ ID NO: 229 - DNA (genomic), 2719 bp, PORYPHYROMONAS GINGIVALIS; double-stranded, circular
  misc_feature 1...2719
  hypothetical: NO
  anti-sense: UNKNOWN
gcagatcggtttttgagccgatgattttcagcgtgtcgtcgggagtgaaaccataccatcgggagtaaaaaatcacaggaatacccacagccgacccttccaacctctccaaaatccgggggtctccacggcttttcggtcgggaaaatgtcattgttcggcgtgcaaacctgcaaatcggacacgaaattcactgctccaacttggaggacgacaaatccgcgcggaaaatgcttcctccggcttggagcgacttttttcggcccgcaatgcagatttcctgtcggacattccctcttttgccgaaagtacccgtatatcccttgcagagagtgaaactgtcgcacggccttttcgtcgaatccttttgccgcagagtcgatccctttattcgttgcacatccgggcttcggcaaatacggcttccttactccgttaatgctctcattcatttagagaatgggatcgggaaaaataagagacacgaacggaatcttacctatcttcgtcctgaaattatggcagatcgtagaagaaccgatgacaataagggtgcgagagaggtggtattgctgctgaatatcggctcgccggacagccctgaggagaaggacgtggcgcgctacctcaattcttttctgaccgacaggaggatcatcaccttgccttttctcctgagacagttactcgtgagaggtatcatcactcctttcagaaagaaaagttcggcacaaaaatatcggaccgtttgggacgaaagcacccggtctttccccctcatatcgcatacgaaagccatagcccgggcactggcacatacgggcagagaagtccatgtagccatgcgctacggcaagccggctgtggccgatgtgctgaaggagctgccacacggccgaagcctcgtcgtcctcccgctcttcccacactacgccatgagcagctacgagacggccgtggagcattgcaaggccgaaatccgccgcctttgtccgaatctttccttccgcgtcgtgcagcctttctacgcacacgaagcctatattcgtgtccttgccgataacatcagaccctatctgacgaagcctttcgacaagctcattctttcctatcacggcattccccgcgatcatttggacaagaccacccgacaggctttgaatctccggcatcccgaaggatgctgcacggaggaggatcctacggcaaacgtctgctaccgctatcagacttacaggacgacggctctcatccgcgaggcacttggcttggccgaggagcaggtggagcaggtgttccagtcacgtgtaggccataccgaatggctgcgccctatttgatcgaacgactgtccgcttggccgcaagaggaaacaaaacgtatcctcatagcctgcccctccttcgtgtgcgactgtctggagagcctcgaagaagtagccgatcacggacaaagcattttcaaaaaagcaggaggtgcggatttcacttacatcccctgtctcaatagcggggcgaattggatcgatgctctccgaaacattttagaggaataatacagcatgctcagttatcataccgatataccgacagacctgcccctcctgaggcaagccgtcgaagccatccgccgggaagaatccggcggtgccgtacccgactccgatcggccgagggtgatatacgaggcgcgcaaccggctttacgccatccgtaccgcacagggagagcaggtggtgaagagcttccggatccctattgccattcagcgcgtggtctactcattcttccgcccctcgaaggctgctcgctcttatcgcaacgccatacggctggggcgatgcggcatcggcactccgcgaccgtcgggctatgccatcgaacgcgaaaaagggcttctgtgcaggagctactacgtctgcgaaagcatgcacgactgtcgggatattcgtctctccatgcagggagtggaaggaggcgaggccttgctccgtgcgctggccggattcatcgcccgaatgcaccgagcaggcattcatcacattgatttatcgccgggcaacgtactgtatcggacagacgagaaaggcgagtattcgttctacctcatagacctgaaccggatgaagttctacgacaagccgattgtggggcggaaagcctatgccaactttgcacgtctgagcttttgtccggcagtgagcaagcagcttgccgaatattatgcagaggcacagggcttgaatacggacggagtggtccaaggggtacaaagcgaatcggatcggttcttccgcagcaaagtccgcaagtatgctcgcaaggcattggtgcgcgaacaaaagcgaatgagccgctccgctttccgtcgggcatatatccgctatcgctcggtacgccttatccgaaaactcacgggctgcacccgtctcttccgtatcgagaacgatctgtacacatcctatcttgaagtgggcgacctgcgccatacactgaaaagagccgaaggatattcctcgccgaaaaacgttcaataagaaaaaaggaaaccgaatgaatcgtatagcttttgatgccaagagaatcacatccaacgccaccgggctgggcaattacagccgcttcgtggtcgaagccttggccgcctttcactccgaacaccgctactacctctgttctcccgggaagggcaatccggctctgtactccgccttgcagca

SEQ ID NO: 230 - DNA (genomic), 540 bp, PORYPHYROMONAS GINGIVALIS; double-stranded, circular
  misc_feature 1...540
  hypothetical: NO
  anti-sense: UNKNOWN
agaggctctaccttttcatgctacagacttttctgccactcctgctgatgacttttgccatctgttggtttgtggttttgatgcagtttctgtggaaatatgtggacgacatggtcggcaaaggactgagtgccatcatcttgtccaagatgcttttctacgcagccatgaccttggttcccatggcactcccgctgggtgtcctgttggcctcattgatgaccttcggaaatttgggcgaacgcttggaattgctcgccatgaagtcggccggagtaccgctctaccgcatcatgaaacctcttttcttctctgtggtagccattgcttgcgggcttttcatctttcagaacgatctgatgatccagtcccaagtgaaattctacacgatcctgttttctgcgagaagggcgactccggaactggaaattcccgaaggttctttctacaatggtattccgtgggtacaatctctttgtagccaagaaagatcgccgcacgggaatgctccacgacatgatgatctatgaccactcttca

SEQ ID NO: 231 - DNA (genomic), 1182 bp, PORYPHYROMONAS GINGIVALIS; double-stranded, circular
  misc_feature 1...1182
  hypothetical: NO
  anti-sense: UNKNOWN
ggatgccatcgacgaaagtattatcggtagcggtatcattcgatacgaagtaagcgcacgcttcatttatccctcgccgttggatggagtggaatcttataaggatacggacaagacttctgccgaccttgccataggagacattcagaccaagctgaagccggacgtaacacctctccccggaggaggagtatcattaagctggaaagttcctttcttaagccagttggtttcccgattcggagaaagccccaatcctgtgttcaaaacccttggaagtgccctatgtttctgccgcagccgcacaaacccccaatcctcccgttggcgtagtcattgcagacaagtttatggccggtacatatcccgaaaaggctgctatcgctgccgtttatgtaatgccatccgctccggactctactttccacctcttcctcaagagcaacacaaacagaagattgcagaaggtgacaactccctccgattggcaggccggaacatggttgaggatcaatttggataagccgttcccggtgaataatgaccatatgctttttgccggtatcagaatgcctaataagtacaagctcaatcgtgctatccgttatgtaagaaatccggataaccttttctccattaccggtaagaagatttcatataacaacggagtctctttcgaaggctacggaataccctcgctcttgggctatatggctatcaaatatctggtggtaaataccgatgctccgaagatcgatatgtcgcttgtacaggagccttatgctaagggaacgaatgtggctccattccccgaattggtcggcatatatgtctataagaacggaacatttatcggcacacaggatccatccgtcacaacttattcggtttcagacggaacagagagcgatgaatacgaaataaaactggtatataagggatcgggcatttcgaatggcgttgctcagattgagaataacaatgctgtcgttgcatatccgtctgttgtaacagatcgtttcagcattaagaacgctcatatggttcacgctgccgccctctactcattggatggcaagcaggttcgttcttggaacaacctccgcaatggcgtgacattcagtgttcaaggacttacggccggtacttatatgctcgttatgcagacggcaaacggccctg

SEQ ID NO: 232 - DNA (genomic), 2638 bp, PORYPHYROMONAS GINGIVALIS; double-stranded, circular
  misc_feature 1...2638
  hypothetical: NO
  anti-sense: UNKNOWN
agtgtaaaatgaaaggataaaggggataaagggcctgcttattgcgaaaggtcttcatacgacaaaagcaaatcctgaagatcgatctgcggcgaatggagaaggaagaggaagggaggggcttatttgggctgttgccccattgccttgcgaagttgtaggggtgtattgccgagcatcttgcgacagaaagcacagaggtagctgacagaggagaagagattcttttccgctattgccttgagagacagagacggatcggccaagtctgtgtagacatgcttggccctttcttcatgcatccatttgagtggcggacaactgaattcctgattgaagtgacgtttgaaagaactgagcgacagattcattttggctgcaagctcttctgccgatcggcactccaaatggtgtcggaatacgaaagcacgaaagcccttgttctgacagtggaatgaggagagaaagttgtctaaaagcggcttttcgtagcgtgagcggaagatgcagaagagttcgcgcagtttcagctcgaatatctcggacgaagtgggcatttctgacaaatatcccatcacagagtggagccaggagttcaccattgtctctcgttgcaaggaggagatgtgaacgatttcggttcgtctccggcattctttcttattgcccgaagagggacaaatgccgaggcataaatggagcgtgggatggaaataaaagcaaatgagcgtagccgggcctttttcagctctaagtcttatacgaagattggcagccaaaaggacaacattatctcccgacaattgcgaattaccggattccggcccgacaaatacggccggctctcctttgagcaggaagagcaaagcatggctgtctttggtccagatttccaaatcagctccttgtcctaccgtgtggagttcgggcaatccggacagagcagtggtcggtcggctgttgttcaggatgccattcggattttctttgggagagacaggctgacagatatgaatactcataaggaggatggtcgggcgttatctttggcaaagcgagctattatgtgacgagctgccttgtccgaggtattgtccgtaccgatgcttttgcggatggagtcgtatccggacaactgtgcttgtcgctctgcggacgaagcatcaaggagcggagacaaacttgcggccaaccttttctccgtgaacaaggctccgaaaagttcgggcactacagccctgccggcaatgaggttggtcagcgaaataaaaggcgtaccaaagcaatacttgaaaatcagattggtcagtcgacctcctcgaatatagtagcatacgacctgtggcgtaccgatcagtgcggtttcgagcgtagccgttcctgaagttacgagggctgctttgctctctcggagtatttcatacgtgcgtccgaatacaacgggaatgctgtcgtcgggcaaaaatggagtatagtcctgtatcgtcagtccgggtgcaccggctatgacagggcggtagtccgggaattgcttcatcacacgcagcatcacaggcaaattctccttcacttcgagcaagcgacttccacagagaagggctacttgacgagaatctttggctgaccgctcttgctcttcgatcgtaggccgcatgtgttgcttgacggcatcatagcacggattgcctacatagatgacaggaaaatcgtgtccggcaaaaaaatctttctcgaaaggcaagatgcagagcatgagatcgacgtatttcttcaacgtcttgattcgccaggatttccatgcccagaccttaggagagatataatagactatcggcttgccaagctcttcgcgtacaaacggaagtacgtagcgcatattgaagcccgggtagtccactgcgatgacaacgtcggggttaaatgctcgcatctgctcctgcacatgttcgcccgcgcggcggatgacaccgaggtgcgtgagtaccggaatgaagcccatgaaggctacttccctgtaatgaaagatcggtcgctctccggtagcctcggacaagaaatccccccccatgaatgcaaacacggcttccgggtcatgctctttcaaggcacgaaccagattggatgcatgcaggtcgcccgaggcttcgccggctacgatgaaatagcgcatacgcaataaagaaaatcagggaaaggggagaggagatcagacgctcctcttgagaagttcctccaagacaggtagataacgtctcgaagtcatattcagtttgatgggagatagtgtaacgtagcccgcatgcatcagttccaaatcaccctctatggtgcctttattgatctgacgtcctgtcatccaatacacagcattgccccgtgcatcttcggaagccatgtattcgtcgacaaaacgaccgtccgtaacggcgcaaggctttagccccaaaggttttcccttcggaacattcatgcttagcatcgtgtcctgaggcaagccattcttcaggatcatacgactgacatgcacggcataggccgtggcatgactcatatcgcaaatctcgctatggtcgtccagcgaaacggccagagccggcacatcacacacacatccttccatcgcagcacccaccgtgcc

SEQ ID NO: 233 - DNA (genomic), 449 bp, PORYPHYROMONAS GINGIVALIS; double-stranded, circular
  misc_feature 1...449
  hypothetical: NO
  anti-sense: UNKNOWN
cagctcctcctgtcgctcaaaaaaaacctgcagcagcacagtatcatcagcgaaaccacgaacacgaactaccggcaagagttcgtccaacttggcacgcagatgagtggtaagctttccttcgaagaatggaaagaactgtaccgccggatcgtattctgggagatagaactggaacaagccgacagacagatgggcgaactcctcgaaatgcagaaacaggaagccaaccgtctctttgcccgattcgtcacacaaaactatcgggaatggattgccaagccggatacacgttcgacgatgagcccggatcttttcaaacaaaaggtattccccctactcgacaatggcgaaaaggtattcttcatccttcatagacaacttttcggcaggatcagtgggagagcgtgaaatccatgctcagcgagttttacaccttcgaagaagat

SEQ ID NO: 234 - DNA (genomic), 1910 bp, PORYPHYROMONAS GINGIVALIS; double-stranded, circular
  misc_feature 1...1910
  hypothetical: NO
  anti-sense: UNKNOWN
ggtgaagatgtagtcaataagaacttcgccgcagtggatcgaggtggcgatgtggtagagataacggtgaaacccgaatgggctgacctgcccgacgatcccgtggtacgccacgagggagacacggactttgtccacaacgtggtacgtccgatcaacgcacaagccggagacgacctccccgtatccgctttcctcggacgcgaagacggtacatgggattcaggaacggccgcttccgaaaaacgcggtgtggcagctttcgttcctgtatgggaagctgacaactgtgtacagtgcaaccagtgtgcctacgtttgtcctcacgctacgattcgtccgttcgtcctcaccaaggaagaagaggagaaaaccggcgtcaaggtgctcaaggctgtcggaaaacagttcccagacatgggcttccgcattcaggtgaacgtaatggactgtctcggctgtagcaactgtgtggatgtatgtccgggcaataagaatggcaaggctctgaccatgcagcctatcgaggagcagtacgaagaaccaaaagaactggataagatgatctccggtgtgaccggcaaggctcacttggtggacatcgcagccaatgtgaagaactcgcagtttgcgacgccgctctttgagttctcgggtgcatgttccggttgcggtgagactccctatgtgaagctgatcacccagctctatggagaccgccagacagtggccaacgctacaggttgttcttccatctactctgcttcggctccttctacaccttacacgaagaacgagcgcggcgaaggcccggcatgggccaattcattgttcgaggacaatgcagaattcggtctcggtatgcacttggcatataagaagatgcgtcgccgccttgtgaatcttgcagaagaagctcagcagtctccctgctgttcggacgagctgaaagctctcttgagagaatgggtagaaaagcgtcaggatgctgtcgccagcaaagttcttgccgataagatcaaacctcttgtcgctgcctgcgattgtgacatctgcaagagaatcggccgtgtcgattcgttcttcatcaagcgtgcacagtggatcataggtggagacggttgggcatacgatatcggtttcggtggtttggaccatgtgattgcatccggtatgaatgtgaatatcctcgttctcgatacagaggtttattccaatacgggaggacagtcgtccaagagtactccgatcggagctatagccaagtttgccgcagccggtaagcgtatcaggaagaaagacctcggtatgattgctgctacgtatggctatgtctatgtggcacaagtatctatcggagccaatccggcacagacgctcaaagctatccgcgaagcggaagcctacgacgggccttctatcgttatcgcctactcgccctgtatctcacacggtatcaagagcggtatgggcaagactcaggccgaaggcaagagagccgttgagtgtggctactggcacctctggcgctacaatcccgaactggagaaagagggtaagaatccgttccagatggatagcaaagagccgaactggagcgaattcaagaacttcctcaaaggcgaagtccgctatgcatcgctgtacaaggaattccccgaggatgccgagcaactcttcgacgctgcgttcgaaaatgcccaatggcgctatcgtaactacatgcgtatgagtgcggcagactggtcgttgcctcttggtattcaggacatcaaggaagaaaaagactgcgatcactaagcgtatctacgcccttataacaaaatcgaggctgtgcagctaaggattctattcttagtggcacagcctcgattgtttctattcctacccgtattcgttcctgctcaaac

SEQ ID NO: 235 - DNA (genomic), 773 bp, PORYPHYROMONAS GINGIVALIS; double-stranded, circular
  misc_feature 1...773
  hypothetical: NO
  anti-sense: UNKNOWN
aggatccccgcttgaagctattgttcgtacatgtcgttcgagtagtcggagcatcaagcttaatcttggcgctttgggcgtaaagaccaactcccaaaagggacgccgcgatcagcaataataatttcctcatactttaaaacaatttatggtcgtgattcagagaaccacggccgggttaaaaaaacaaaaaaaatccacaaataagattcatttcaagaacaatccaagaaaagaaaaggaatttaaaggcaaaatgctaccttctatttctattggtacttttctcaaggagttttgttgcggcgcaatttagagaaaaaattcgatttaagaagagtatcggattataaagaacatgttttcaatataagcgacaagggattaacccttataaaaggctgtcaattagccttttgccaaaatattgactgtaatctgaaggagaagatgaaagaggaaaaggttcatgctccacctcattaaaagtcagagtcttgtaaaagtgttgtctaacaacacttaaagttattgtgttgcatgtatttacaaccgaaaagtagagcagaccaaggttaagtcagtccagcatgaggaagagagcggaggggaaaggggaaaaaagatccttgactaaggagtcgggggtgtgatgtggaagtaaagagttctcgggctgtacattgttcgaaaagacaatacgccccttactgatatgataggtaccattatgctgagagaaaagagggtcactatatgcgaaagagtaacct

SEQ ID NO: 236 - DNA (genomic), 1351 bp, PORYPHYROMONAS GINGIVALIS; double-stranded, circular
  misc_feature 1...1351
  hypothetical: NO
  anti-sense: UNKNOWN
gactctagaggatcccacggatgacatccgctacatgcggatcgcgctcgaagaggcacgagcggctgctgacgaaggagagattcctatcggagccgtgatcgtctgcaaagggcagatcgttgcgcgtgctcacaacagagtggaaaggctaaacgaccctacggctcatgccgagatgcttgccatcacgatggccgtagatgccataggggggaaatacctccgcgactgcacgctgtacgtgactgtcgaaccctgcctgatgtgtgctggcgcacttcgctggacacaaataccgcgagtagtgtacggagcatccgaacccaaagtgggctacaggctgttcaccgatcatgcactccatcccaaatgccacgtagaaggcggtatattggcggacgaatcggagaatctgatgcgtagtttctttgccgaacggcggtagccgagcaacacattatatatctttgtgcaatatggcagcattcagtgtacatatattgggctgcggatctgccctgccaaccacacaccaccatccctcttcgcaagtaatcgacctgcgcgacaaactctacatgatcgattgcggagaaggtgtccagcgacaattcagacacgaaaagctccatttcggacgtctcattcatatcttcatcagccatctccatggcgatcactgtttcggtctgcccggatttatctccacgctcggtctgctggggcgtaccggcaccctgcatgtacatgggccggagggaatagagcgtttcctcagccccatattggagcagttctgtcaccgaatgccctatcaggtggagatacatacgatcgatgcctcccgacatgcgcttgtacatgaggacaaatccgtcaaagtctatagcataccgctcagccaccgcatccctgcggtgggctacctcttcgaagagaaatgccgtgcaaggcatctgaacaaagcggctgccgagttctacaatattccgcttgccgaatatcccctcatcatagaaggatccgattacacgacaccggatgggcggatcatccccaaccgacacctcacgaccccgggtacaccacccagacgatatgcttactgctcggacacggagttttgtccctccatcgtccctattattcaaggtgtggatttgctctaccatgaagctacttttatggaggaggatcgggcaagagccaaagagactttccacagtacagccaaagaagccgccgaaatagcacgacaggcaggagcaaaacgcctcctcatcgggcattactccggcagatacaaggacgtccaaggtttgctggaagaagctcaaagcgtattcaa

SEQ ID NO: 237 - DNA (genomic), 1840 bp, PORYPHYROMONAS GINGIVALIS; double-stranded, circular
  misc_feature 1...1840
  hypothetical: NO
  anti-sense: UNKNOWN
aatgcatccagatttagcgtaaaaatctcattcttaccctgtattcattaaaccgcttcttaggctcctatagaaatagttgatctttctaagtgcttcttctagtgttttcgcaggtatataaaaagaatatccataacaagcacagcctgtatcaaaataatcctcctcttcttttccatctctcagggatatgataaaagagccaaaccccttggattgtctcgcaccaaagttatggagcataaaaaagttggtgatgagattgttcacctcttctcttagtccagcattctgaaagcgtattaccccttcaactggagtattgacaaatgttgctaattgtaccttctgccagttttcttcaaatattctttttttattttttatttggtctggagtgtcaccatgctttatattaggttctgatttagccttgtcctcattagcaaagtaagaagtcaagggtagcatctcaacctcttgcactcctaacttctcttgtgcgaggctttttaatttatctatttctttcgggttactactcattggcaagaaatactgcactttcgcatcagggcttagcttaaaagagagtttgtagttcaaggctccttcttgtccggggatgagacaaagctccaattttgcacccttattccctttctttttctcttcctcatacactctgcgagcctcttcatctttattttgaaagtattctatccccctttcgataaagtttttttctgttgtcgaagcagttttctttacaaacctcttgcctatctgtgtcaagataaacttgtcgagcttcggtttgacctcggaggcgcgcagcgttgcccctgcatccctggcctggaagtggatgatgggcgtatgctgttccaattcaaattccaacttatacatcgtggtctatgctttttgttttgtattgtccttacaatagacttccatgagtcccttattggtctcaagcaacgattcggagaagctctgccatttattcaaatcctttgttctttctcgttctaattcgaacaatgttttgtctcgtaattcctcctttttgatttttaatttgtagctccatataatggctacgacaataattgtggcagtggctactaccacaaaacagagtaagattaaagtttctatttccatgctattttctgtatttgaaataatgtcttattgggaagtagaggcagatggcaaatactataagcgtaataatatcgccacccaatagcccccatgtcgagggacaagggtccccgatattgaagaagcgagtgatgcatcctttttcaacaaaagtgttgatgcctaaaaagccaacaagtaacgtgataggcaggtagaggttggcagttttgttgagtacaccttgttcctcaagggttgtgtagttaaagagttcgcccatctcttcgtcgagggctttagcatctttctcgatgttcatattgctttgaagcatatcgtacatttctatgccctgtatttgaggggtaacctctcgaaagtaggtctcattaagaaagcggatatagttgccgtacagctctttgacctgcttttcggtttttctctttgtcttcttgtccaatatcagttgtgtgatagaggctatttcgttgctgaagcgtagtatggtggagcgttgcacaaggctcaatgttgccatttggtagtacatagttgtaatatggtctcccataagttcccaacctgaaatacctacgagagagtctttggttagaccaaagagagtaccttctcccgaccatcttgcataggttgttctcctgacatcctccctttgtac

SEQ ID NO: 238 - DNA (genomic), 1563 bp, PORYPHYROMONAS GINGIVALIS; double-stranded, circular
  misc_feature 1...1563
  hypothetical: NO
  anti-sense: UNKNOWN
gatagagatactcttgagaaggattgatttggaagaggttggccgaagcctttccggctattttgccggagctgaacggtaccacatagttgatacctcgtcgatctgcatagcgtgatatagccgctatctggtcattggaggctcctccgataataaggtgacagtcattgagctcaccactgtggatcacatcctctgcatcagacgtattcgatacatcgtaaacgcgcaaagtcaccgacactcctctcttcttcagacgattcagccccatcagcataccctcgtagaattccacatatcgctgggtattgcccgatagagggagcatcagtccgacctctatagcctccgactgcgatgtcgtaggggaggaagccatagccgtggaatcgctgccggggatgcgtagtttgtggcctgcagggaagttggtagcagatatacccggattggctttcatcagttcctcttcgctcaatccatattttctgctgatggagtagagcgtttcctgtggccggataatgtgttcgctcggatgacgagcggcggatattttgctattggcccggaccggtttggacggaatgagcagagtctgcccttccttgatcccttgtctggccgaagggttgagcgtataaatatcatcctccgacagaccgtattggcgcgccagtccataaacggtctctttggcttgcactacgtgtacttttgtcctgctacgcgtctgaccggatgccgatactacggacatcagcacacacgtaatcagcaggatataaagaccttttatccggaatacatgatctgtcatggtttccccctttcttttttagtcctatttattattaggtgagatggggcaaaggtaacaataacgactctgcaggcaaatggttatcctctttgcaatctccatataagagaactacgtggggttaatgtcttcgttataaatcaagccatttcaatatcgaaagacatggttgcttaaggttatcccggattggtcattggaaaagtaaggcctaacgacagattccccgggtttatcgacttcagtcggttgctattgatttgggttgtggagcattcttgcgcgtgagcatcttcgagtccgtgtagatgtccgtacttgctgcgagctgcagtattgcaaaggtgtgatggaagcagcaataagcaatgtgcttctgaatgcccgaagctgcaatcgaataccttagaaggcgatgcgtcataacgaggccggaaactccgtatataaggcgataaatttccgtatataagaaaatttatttccgtatatacacaaatttatttccgtatatacgaaaaaatatttccgcatatgcggaaatctcgctaccttcgtggtgcgataaaacagcaatcaaatcgagatagtaaagtgtttaataaccagataattaagttcattatgattaagattaaagcaatcgaaagaaaggccggattcggcaagaccagcaaaacgctttggtaccctgcaatccacttgcattcggatgtgaagttcgaggagtttat

SEQ ID NO: 239 - DNA (genomic), 639 bp, PORYPHYROMONAS GINGIVALIS; double-stranded, circular
  misc_feature 1...639
  hypothetical: NO
  anti-sense: UNKNOWN
ggatccccgggaaaaccgctgtcattgtagtaggagcaggtccggcaggtcttttcgcagcactccggctcatcgagcttggtctgaggcctattattctggagcgaggtaagtccgtacacgaaagaagagcagacatcgctcgcattcccaaagaggggcacgtagaccccgaatccaattacggatttggcgaaggcggtgccggagctttttctgacggtaaattatacacacgtagtaagaagcgcggagatataaccaaaatactacgtattctctgcaaacacggagcacagccttctatcctgatcgatgcgcatccacatatcggcaccgatcggctacccaaagtgatagaaaacattcggcaccaaatattggcagccggaggagaagttcacttcagttgccgaatggaaagcctgatcatacataacggtcaagtcgtgggagcaagagacaacaaggggcgtgaatactgcggtcctgttatcctggcaacgggacattccgcacgcgacatctatcgctatcttcaccgaaacggcattcgaatggaagcaaaaggaacagctgtcggtgtccggctggagcatccgcagcntctgatcgaccaactgcgctaccacaacccca

SEQ ID NO: 240 - DNA (genomic), 1005 bp, PORYPHYROMONAS GINGIVALIS; double-stranded, circular
  misc_feature 1...1005
  hypothetical: NO
  anti-sense: UNKNOWN
ccgatcgaatgcctcttcacgatggacgaaagagacgggtatgaccggtncgatgaacctaaagcccggatttttcaatgnaaagatcctgctcaacctcgacagcgaagacgaaggagagctcttcatcgggtgcgccggaggtatgggaaccatggtcgaatttgcctacgaaaagcgcgaagcgacagacgactatctctatttcaaggtaaaggtcagcggtctcaaaggcggtcactccggaggagagattcacatcggtctcggcaatgccaacaagatcctgactcgctatctctatgctcttgagcacgaattggattggaagctctgctctttccagggaggaaacctgcacaatgccattccgcgcgaagctcatgccgttatcggcctgaaggctgatcagaaagaacgtgcacgagttatcttgaacgaactcgctgctgcagtggaggacgaactcaagcgagtagatccgggtgtgaagctcgaaatgaaatcggtaggaaagcctgcatatcgtatcgattgtgacacgaagcgtcgtcttgttcgcgccctgtatgcttgccctcacggcgtctacggtatgagccatgacatcgaaggtttggtggaaacgtcttcaaacttggcttccgtgaagatgaaagaagatgataagatctacgtggagaccagccaaagaagctcgacatcgtctcttatcagcgatatagccaatacagtggcatccgtattcgagcttgccgatgctaaaatcagcttccgcgatccgtaccccggatggaaacccaatcccgattcgccgattttgaaagcggcatctgagtcgtatgagcgcattttcggtcgtaaacctgctataaaagcaatccacgcaggtttggagtgtggtctcttcctggataaatacccctatctcgatatggtttcattcggccctaccctccgagatgtgcactctcccgtagagaagatcgaaatcaagacggttca

SEQ ID NO: 241 - DNA (genomic), 517 bp, PORYPHYROMONAS GINGIVALIS; double-stranded, circular
  misc_feature 1...517
  hypothetical: NO
  anti-sense: UNKNOWN
gtagcctctctcattcaatttatgagctaaatccaaaatcaaatcacaacctttatcaggcatgatacgagagaaaaagacaagacgcaacaccttggatggagtatagggagtatgacaatgcaagggagaaaacagagatatgtccttgaagttaggcataacttttacattctctacaccttgcccacacaaagcatctttcattgcttgcccttcgaccaaaagatattgcaaacttttcaaaacatcaactcggtatcttcccttctcaacttctaaatgaagatccccccctattacccaaagaacaatcttacgcttaggaaagacaactttcaaaatacggtgcaaccaatacacattgccataactagttgagaaaattatgggagtattgggatttattaataagataaaaggcaatttccacaatcgccaaggcttagaacgactccgataggtatcaactataattagtttgncaacaaagtccctaagccttttcgttaggaat

SEQ ID NO: 242 - DNA (genomic), 700 bp, PORYPHYROMONAS GINGIVALIS; double-stranded, circular
  misc_feature 1...700
  hypothetical: NO
  anti-sense: UNKNOWN
atactttgncaagtttaatttttagttggtctagcagctctttttcaactaatggtatattttttctgtggatctgctttgtatttttaggagcttttgatacttcttttgatgaggattgttgtgttctatttctattaactagagaaatttttccgcctttgcgatggaagatctctgggtatgtgcttgctctcgctgaaatttgatttgggctaatttctgaacagtcttctttctgataccacttgtttttatttaatttttctgcgattttatcttttgtcatacctcttccagcctctctgagtaatttctccattgcttcgtgtagtgtcatatgccttttgttaataggttctattttgaatttttttgccatgttttagcgtgaataagttttttcttattttctttaactaaatagttatcatcctaacccagagtatactcaattaccttgagctttaacctaagataaagttgattttacttgtaatcagcttatttattttgcgaatatacttattttaagagaatgaagtccgctgattgattgtttatgagtcaaatctgaatctatacaaagagtgcgccggatctttcggatcgacgcactcctttcgttgtttagtcttgtggattgtctattggtctccggatcgtattcgggttagagccctcctcctcctgatccctg

SEQ ID NO: 243 - DNA (genomic), 437 bp, PORYPHYROMONAS GINGIVALIS; double-stranded, circular
  misc_feature 1...437
  hypothetical: NO
  anti-sense: UNKNOWN
ggggaaaacgactctgacggaaaaattcttgctcttcggaggcgccattcatgtggcaggagcggtcaaaagcaacaagataaagaaaacggctaccagcgactggatggagatagagcgtcagcgtggtatatcggtggcaacttccgtcatgggattcaactacaaggactataaaatcaacatcctcgatacgcccggtcaccaagattttgcggaagatactttccgtacgcttactgctgtggacagtgtgatcatcgtcatcgactgcgccaagggggtcgagacgcagacgcgcaagctgatggaagtttgtcgtatgcgcaagactcccgttatcgtcttcatcaataagctggaccgtgagggacaggatcccttcgatctgctggacgaggtggaggaagagcttcagatccgtgtgcggccactct

SEQ ID NO: 244 - DNA (genomic), 406 bp, PORYPHYROMONAS GINGIVALIS; double-stranded, circular
  misc_feature 1...406
  hypothetical: NO
  anti-sense: UNKNOWN
gcgaataggcctgacaacaccgtagccatataggctatcagcacggtgataagaagcatcctgccggcacctttcccgatgtcggcaatagccaccgtcaccaatccgaggataatcagcggaatggagaagccgagcagttcgctgaagagagcattgaacgtgacgaagatccgaataaacgggaagctgaagaggttgccgaagccgataccgaggacaatggccaatatgatcttgggcaagaggccgatccgtagtttacgcatatggttgggggttgcttgatcaagaagattatttgttggaaatatagcggaagttagcatccagcagacgacgggcagcgacgaaactcctggcacgatcttccaacacgtctcttcgactccggtatgagctctga

SEQ ID NO: 245 - DNA (genomic), 862 bp, PORYPHYROMONAS GINGIVALIS; double-stranded, circular
  misc_feature 1...862
  hypothetical: NO
  anti-sense: UNKNOWN
ggtttctgtaccaaaagtagtccattcttatcgaatagagccatcggcagcgcgaaaggcgaatcaagaaacaggaaaagggtacaccccggattcttctcgcattataatccaaggtaatacaggatgcacgtctatacgcccatataccttgccatcgacattgcggatggaattatgtacttgtttctcataagcctttcattcttttaggatagatttaacaatatgctataaagacataaaagttgtgtgcctattcataatttacgaacggcaattcgtcaaaattccccacctttgccctgcactatcagggaaagaacgatatgaaaagactgataacaacaggagcagcctttctactggctgctacactctctgcctgcaacggcaataacacaagtgaaacccaaggcgatcggactgaacaggccgaaacggtacaagccgatctcttctcggccgactcggcttacaccttcgtgcagcgtcaggtgaacttttggccctcgcatccccggcacagctccgcatcgtgcctgtggagattggctcgtggccacgcttcgcagctttggtgccgcggtgcaagagcagacagccgaaatcaaagcgcatgatggcaccatgctgcccatgcgcaatatcatagcctcataccgccccgaagccaccgggcgtatgctactgatggctcactgggatacgcggccggtctgcgatcaggatgccaaccccgctatgcacacagagaccttcgacggtgcggacgatggcggcagcggaattaggcgttattattggagatagcgcgctatctgggacaacagaaagatttgggcatgggcatcgatattgt

SEQ ID NO: 246 - DNA (genomic), 738 bp, PORYPHYROMONAS GINGIVALIS; double-stranded, circular
  misc_feature 1...738
  hypothetical: NO
  anti-sense: UNKNOWN
gccgagaaagagcaaatgattttttcgagcgtaaaacggacgaattgccgttcgtgttttccggaaaaatggaaccataaatttttcgttttggtttgagaacttttttcttccggcgcgggaagtgaaaaattctcgcgccacgttttttcgttccgtctgaaacaattttttggaacgtaaaaactcgaagagggcgagggcggatcaaaagaaaataagtccgaatcggaggaaaaaagcagcaagccaatgcaggttcaaaggcaagttgtgtcgtttttcaggcttctccatttgctgtataacttccgtctaatcccgatcttggcagcagtatcggtggagttgggactttcggacaattatcaacggtgctcaattcattatctttgcagcaatttagatacgaaaaaataatctgaacaataatggatagacaattcaagcgaactcttattactacggccctcccgtatgccaacgggcctgtacatatcggacacttggccggtgtctacgttccggccgatatatatgcacgctatctgcgattgcgtggcagagactgcctgctgatcggcggttcggacgaacacggtgtacccatcgccctgaaagccaaagccgagggatgcactccgcaggaggtggtagaccgataccacgaactgatcaagccgttcgttcgaagggctgggtatctcttcgacatatacttaacgtaccacaagcgac

SEQ ID NO: 247 - DNA (genomic), 3779 bp, PORYPHYROMONAS GINGIVALIS; double-stranded, circular
  misc_feature 1...3779
  hypothetical: NO
  anti-sense: UNKNOWN
ggcacatctatctcttccagcaaatcctcagctacgggtaaaaggagttcttttccttcgggcgtagttatagacaaaaggacattgagcgtactctcgtccacatcatcgattgtccctacgaaacaaccttctcggtcgaataccgtaaagccgatgaaatgttcccaggtgaattcgatagaatcagtatcgaagtatcgtcgttccataaagagagacacaccggtgtactgctccatctcctccttgctttcaataccggcaaagcggaacaaagtaatatcatcggttttctcacggtagccaataagacggaacggaaccggcaatgcatccagctcgaaaaagagaaacaaccgctcttcttcctcaaagagcgtactcaaatcggctgtcagacgagcgttgcactctccctgaacgccatgcggcttacccagcacaccgatatgctccaatgaatccaaatcgatcataaagcatcaaaggcgagagatacgtgcgccgatagcgttgaggcgagtatctatggattggtaacccctatcgatctgttctacgttgtggatgatacttgttccttctgcactcatagctgcaataaggagggctataccggcacgaatatcgggtgaaaccatagttgcagctcgcaagggaacacgtttgtccaaaccgatgatcgtagcacgatgggggtcgcaaaggataatctgtgctcccatatcgattagcttatcgacaaagaagagacggctttcaaacatcttctggtgaatcagtacactgcctttcgcctgagttgccaccacgagaaagacgctgagcaagtccggagtaagacccggccaaggagcatctgcaatagtcatgatggatccgtccataaacgtctctatctcataatgttcctgcttaggaataaacagatcgtcgccttgctgctccacagcaattcccaaacggcggaaagatgcaagggatgaataccccagatcaggcacgctgacatccttgatcaaaagctcggaagcggtcatcgcagccattccgatgaagctacccacttcgatcatatcgggcaacatcttatgctcacagccatgtaagctctgtactccttcgatacgaagcagattagagccgacaccctctatatgcgcccccatactaagcagcatcttgcaaagttgctgcagatatggctcacaggcagcattataaatagtggtaataccatcagcaaggacagctgccattaggatattggcagtacccgtcacagaagcttcgtccagcagcatataagtgccggaaagccggcttgcagtcaattcataggcttgcatatcggaatggtagtcgcacgtggcacctaatgcctgaatacctacaagatgagtatctaacctgtggcggccgatcttatctccccctggtttcgggaaaatggcgtaaccgaagcgactgatcagtggcccaacaagcaagaccgaaccgcgcaaggcgcgactcttttcgagaaactgctcgcttttgatatagtcgagattcacattatcagcttggaaaacacaagtatcgcgggtgggtctttttaccttaacccccatgtttcgaagcaggtcgatcaggttgttcacatccaatatatcggggatgttacgcaccacaacctcctgatcggtcaatagcgtagcagagatgatctgcaaagcttcgttttttgcaccctggacgagaatctcacccttgagactgttgcccccttctattacgtaagatgccatagagataatgtgttttatatgtctgtatgattatttccgccggaataccttgttccgtttggtgttgttattgtccttccgatccgaagcattcggtatcgtcagatgacaactctcctccgtcagctctatgcgcccttcggacagttcgtacaaatccttgaatatcttgtagtcatccaccgtatctttgttccatgtcagatacgaacgcttcatctggttggcgatgagcagctccagcgcataacgctcttctccctgctccatggcacaagccttgaggatcatttcctgtatgagatggccgtagtgccgatatacgatgtcgttggccgagtagcttacagctttaggcttccgttcgagcagctccggactgatgatctccatcggataatcgatatccaacttgaatccggacataatagccagatgatcccaaagaatatgcttggtctcactgttttcccgccgttcgggaaacatgtttcccatgattgtaatgatcgtttgtgcacagcgattccgttcgtcacgatcaccgattgtcatgcaataatttaccatgttttggatattcctgccatattccggaatagccaaaggttccattttactattataattcatcctctgatgtttgtaatttctaacactctttcagtcggcctgccattgctgctgattctgtttcatagccgggcttgttcagcaaagcaaacatattgttcttataaccttcgacccccggttgatcgaaaggattcacacccagcatatagccactgacgcctaccgctttctcaaagaaatagaacaactgccctatataataagcatccaattgcggcaaaatgatgcgtatattaggtactcccccatctacatgagccagccgggtacccaattcagccatcttatttacttcgtctacacgctttccggccagaaagttaagcccatccaaatccgccgagtcggaaggaatcgtcaagcatgtatcttgattttctacggaaatcactgtctcgaatatcgtacgttcgccctcctgcatccattgtcccatggaatggaggtcggtagtcagatccacagttgccgtgaagatccccttctcctctttgccctcgctctcaccgaaaagctgcttccaccactctccgatatagtgcattttgggatggaaattggccagtatctctatcttctttccttcggcatacaaagcattgcgagctgccgcgtatcgtaaagccggattgtccgaaaaaggaatgtctgaagccgtcatggcttgcatatcggctgcacctcgtaccaactgacgaatatcgaagccggctactgccacagggagcaaccccacaggagtgaggacggaaaaacgtcctcccacattgtccggtatgacgaaagaacgatagccctcttcatcagccatacgtcttaaagcacctttggccgaatcggtaacggccacaatcctctcccgagcatcttcacgtccgacctgcgattccagcaatcctttcaacagacgaaaggcaatagccggttcggtagtcgttccgcttttggaaatataaatgataccaaatctcttatcacgcaggaactgtagcagttcggaaagataatcctcaccgatattattgccggcatatagtataacagggttctccctgtccgagcgatatgcctcgaaactgttttgcaatgcttcgatcacagcccttgctccgaggtaactgcccccgatacctacgtttattacatagtcgcaacgttctctgaggatagtagctgcagcttctaccgcgttcaattcctcttccgtgatggaagatggcaaatggacccaaccgagaaaatcgctccctcgaccggtaccgttatccagcaaggcattgaacttctccgctgtctctccataagaagccacagaagaacctgttttagacagatccaatcggattcttt

SEQ ID NO: 248 - DNA (genomic), 921 bp, PORYPHYROMONAS GINGIVALIS; double-stranded, circular
  misc_feature 1...921
  hypothetical: NO
  anti-sense: UNKNOWN
tggcgcttacaaaacgaacaggatccggccaaacgtcagcagatcatcgataaaattctcaagctgtatgatgaccgtgtcaaatacttcggagaagaccccaagtatggaacggactatatcatggccagcaaaatatcggactacatgcagtatatgggcgataaaacggattatgacaaggtttatgaatggatcaagccgaccatcgatcagcatggagagaatgctacgcctcgagctctattctattatgcttactcctctctgaacaaagctatcagaaatgaggcatggcacgaaacctatattaaggattatacgtttgcatcccaggccatggagaagcagttggaagtggccgatgagaaaggcaaagagtttatccaaccgctgaaaactcagatcgacgaactcttcgcccagagtggtcttgcagactgcaatactttggtgaaaatgtatggcgataagctggaggaaaacaagacggatacgactttcctgaagaatatgctcggcatgttccacgcttccgactgcgagacacatccgctttatttccaagccaataaatacctctttgccgtacagccctcagctatagctgctatgggccttgccaaagaggcgatggaaggaaatcgatacaatgaagccagcgactatctccaaaaggctatcgaactaagcaagagtgccaaagaccgtgcagcctgcaactatacgttgggtctgttggctatgaagcagggtagttactctacggcacgctcttactgcaataaagcactggccgaagatcctgcgatgggcgatgctcttatcctgattgcccaaatgtatgcagcaacggccaatactgtcttcccggtgatgctatcaggcacgctgngtatatttcctgccgtggacaaactc

SEQ ID NO: 249 - DNA (genomic), 4158 bp, PORYPHYROMONAS GINGIVALIS; double-stranded, circular
  misc_feature 1...4158
  hypothetical: NO
  anti-sense: UNKNOWN
gatttctttgaaagcatatgatgactttctaccatcggcacgcaccaacaacagctctccggaaggcaatacatcggcaattatggcatcgaaacgcccttccttattttggaagggatggtaccctaccctcctgtaaagacactgcatataacgagtgtgaagctggtcggcagtatgctcttctatgtgtctgtagagtgaacgcatctcctgcataaaagagcggaatatctctatacgatctaccgaatgccccagaatgatccggaccgatgtaggattggggagatagctcggatagtcgctttcgttgatattgagaccgacacccagaatgctgtagtcgaggttgctgcccgtcaggctgtgctcgatcagtatgcctgctattttcctgtctccatagtatatatcgttcggccatttgatgctgagcatctcggcagaaggaagaaggtcgtagagtgtatggagcacggagagtgcacacaatcgggagagatcgaattgctgctgtgcaggaagcatggtcggcctcagcagaacggaaaaggtcaggttcaagcccggagacgcgaaccagctattgccctgctgtcctcgtcccgcagtctgattgtctgtcatgaccacggtccacgcaggtaggtcgggatcctgcatcaaaagatcggacagataggagttggtgctggccgtttcgggcagatggatcagatacccttcagaccaactgttcttcttggactccatcgaaaggcggttgtgtacggatgtatttagggagtttggatacaacgagagcgtacgaatgtcggatgagccgtgcaatcagatcggcaggggcatccgagtccaaagctacgctgttccaatgtcgtttgttcatatgaaaagcccccgtgataccctcgtagtgcatccttaaatgttcggaccgatcgggatcgcatttgagtgcgatgactttcttttcggaatcaaggggtatcagagcaaacattttgccggctactttcataaccaacgtaacatcatcgaacgggaaactctcctccacctgtggcagtgacaagcatagctctcgagcttgctctatgtccatatattattttatttttgctacgttatgaatttcgctccacttttgcttggggcacggtctaacaaaaataatggaaaaactcatttttgccacaaacaatccacataagctcaacgagattcgtcatattcttgagggaaaggtggagattgtcgggctggacgaaataggttgtcgggaggatattcccgaaacggccgacacactacagggaaatgctttgctcaaagcagaatttgttcacaaacgatatggtttaccttgctttgctgacgacacaggcttggaagtagaagctcttgacagagcacccggcgtccactctgcacggtacgcaggagaaccgaccaatgccgatgccaatgtacggaaactactcgaagcattgagcagtgtaccacatcccagaaaagcatgcttccgtaccgtgatcgccctgatcgatgatcatggaaaacacttcttcgaagggaagatcgaaggtaccatagcatctgaatgcagaggatcgggcggcttcggctatgaccccgttttcatcccggagggacacacgctcagctttgcagaaatgggagaagaaaccaaaaatcaaatcagtcatcgtgctttggcggtggcacagctccgcgattttttattatgtgcaaaataagattcagcctcttgcaggctcttgtcgtctgcttattgttcacctctttttctctccaagctcaagaggaaggtatttggaataccctcttggctatccacaagacggaaaaagccgtagaaacgcccaagaaagtctttgccgtagccaacggagtactttactcggtgggcaaagaagctccccatgaggcaaagatcttcgaccgtatcagcggactcagcgatacatcggtaagcagcatagcctactccgagcaactaaaatccttggtcatatactatgcatcaggcaatatcgacatcttggacgaagcaggccgtgtgaccaacgtacctgcattgaaagacaatatcgatctgatagacaaaacgctcaatcgccttttgatcgtaggcaacagggcttatttggcaggaggattcggcctctccgttctggatgtcgccgaagctcgcataccggctacctacgccaagggaactaaggtgaccgatgtggctaagttggacaatgatcgcttgctgatgctgaaagaagggcagctcttcatcggaaaagagaccgataacctgcaagatccggccgcatggacagccttgtctttgaatttgccgatgggctcggtcaccggtctgggcattgtcggggaagacatctgtttcctgctcgccgatggccgtgtatatgtcgctgcaaaccaatcgtttgagccggagctattgctctcttcctccgccgattcacgactgtatgtgacggatcgtggtctgttcatctgtgccgagaatcgaatttatttcatagaaaaaggtcgcaaaacgacacaatttcctatagccgacgtccttggtgtcggtgccatgaacgaaagcaatacggcatacatagcattgggagaagaaggtttggcttcacttcttctcgcagagggaagtacggccgaagccatgcctgtagcattcgacggaccgggggacaatgatttctacgagatgcggtttagtcacggacgtctgtatgcagccagcggactctggggaacaaacctgatgggacatgccggtatggtgaagctatacgacggcaaccgatggactaacttcgacaagaagaccgtacaggaacagttgggcggcggattcagtttcaatgatgctatcgatatagctgtttccaacggagaccccgatcacttttttgtcggtacatggggaaacggtctgttcgaattcaaggatggcaaagcgatagctcgctattcgggaaacgaaactgctatcgcagaatgtaatcccggagatgcccgtgtgaaagcgattgcctttgacaataagggcaacctctgggggacgctcggtgccgtaggcaagaacatcttcatgtacgatccgcagagtagcacatggcattctttcagctatccggatgtagccaatctggcctccttcggcaatatgattatcctacccaacggagacaaatgggtaaatatccttcaccgtagtggcggatccacgcgcaaaggtgtcttgatcttcaacgatcggggtacaccggaaacgacttcggacgacagccatctttacgtcgagcagtttgtcaatcgcctcggggcagccataggacataagactatctatgcaatggccgtcgatcataacggctctgtctggatgggatcggatataggcattttcggcgtctacaatgcagccggagtattgtcctcgacttctacccctatcgctgttcggccggtcggaggagaagaacccaatttgtactatgtgctggacaaggtgacggtgacagacatcgtcgtggacaaactcaatcacaaatgggttgccacccaagggacaggactctatctcctttcggaagattgcagtaagatcctcgcgcaatttaccgtagaaaacagccctttgctttctaacaacatactatccctggccttaaatgacgataacggactgctgtacatcggtacggcggacggactgatgacgttccaaacgggtacggggagtggatcagcttccgaactggacggcgtctatgtataccccaatccgctaaggccggaatatcccgatggcgtcaccattgccggactgcaagccggctgtagtgtcaaaatcaccgataccaccggcagactgctataccagactgagagcgtaaccaccgaagtcaaatggaatgctcgaggtgccgatggcaatagggtagcttcgggcgtatatgccgttgcagtgtacgatccggtatcgaaaaagtccaaactaattcgcttcgcagtgattcgctgacacacggcctttttctctcgtaaacaacattttaatccaaactaataggtaatgaacaaaaagatttttggtgcatc

SEQ ID NO: 250 - DNA (genomic), 694 bp, PORYPHYROMONAS GINGIVALIS; double-stranded, circular
  misc_feature 1...694
  hypothetical: NO
  anti-sense: UNKNOWN
cggactggcacccgaacgacaaggtgtctttcttcttcggacgtcagtacgcgcgtttcggagggatagaatacgacatgaaccccgtagagatctaccagtacagcgaccttgtggattacatgacctgctatacttcgggcgtgaacttcgcatggaacttccaccccgaacagcagctgcagctacaggtactcaatgcttacaacaaccgcttcgccgaccgctaccacgtgacacccgatgtcgctaccgccacgagctacccgctcctctactcggcacagtggaacggtaccctcctcggaggagcactgcatatgcgttacgccgtgtcgatggctcatcaggcccaagagcgtaatatgtggtacttcactgcgggcaacctgttcaatccgggcaaacggatcaacggatacctcgacctcacctactcgatcgagggattggacgacaaaggcattatgactgctcgctacggcaagggcaagaccctcacggacgtcaagtactatgctctggtatcgaagtggaacttccgcattttcgatcaggtcaatctcttcctcaaaggcatgtacgagaacggctatgcgcctgcccaatacggcgagagcagccacacgcgccaactcctacggctatatgggaagggtggaatattacccctacggagaccaactttccgtct

SEQ ID NO: 251 - DNA (genomic), 873 bp, PORYPHYROMONAS GINGIVALIS; double-stranded, circular
  misc_feature 1...873
  hypothetical: NO
  anti-sense: UNKNOWN
ctgggttataacggtgtttttttggctttcactcgccacaatggtaatcaccttgtcgttcttggccagctctttgatcaattccatcgggataccgaacgggtagcgtaccaaaacggctgcagagcgttcgtactcagcgatagcacgcacaggacctgcagggggattcgtttcctggaatgctcgttgcatctcttctgttgcaaattgaccgtttgttcggtctgcttgcatttgcgtttgggcgattgcgggcagttggaagagtcccaatgccagaatcaaggctttagcctgtaaaagctttttcattgtttgatatgttttatgatgttatgaatatgttcctgaacatatgataagatctcggggaaataataaagagggacatgggccgatctttttgcgaaatatccatggagggatttaccttcggtttttcacctccaacccgataaccgcccgtaaaattagaagaaatcatcaatatgaaatataataaacctgttttcttgctttttgagccctttgcaaaaagagaaggtcatcaagaagtatcttttcggtatcgtttttgctcacctatagagtgtatcgcacaagtcatggaggaggctttagaggtattcatatctataatgacactgaaaaatcagtcaattgacaatgaaatctcccggaaaatgccgtgcgacagtcttatctatcgggttcacagctcgcacggaacctccacttcccgatcctgccatccgacacagagcagatagcatcttccatcaatagaccatagtatcctctcataggagaccataatatcctctcataggagaccatagtatcctctcatgtgagaccatagtatcctct

SEQ ID NO: 252 - DNA (genomic), 923 bp, PORYPHYROMONAS GINGIVALIS; double-stranded, circular
  misc_feature 1...923
  hypothetical: NO
  anti-sense: UNKNOWN
gtcgttgatcagtcccactacgcgacaacctttaggcgtatgtttacggaagaacttactgcttggctggaagattatagtcttggagaaatttgggagaaaaatatcattggtggacaaccttgggctaagtagtgagatggggaatatgaaaaaacggcttgtttttattgtcgagggagatacagaggttgcctttatccatgaacgtgtgatcccatacctaatgagcaaaggctaccgcaatgcgatgaatgcccagaagatcaccaccaataaatcgcttcataaaaagggtggtatagcccgcttcgaatacttggaaaatgaagttcgaagcgtagcagcccaaggagatatcttgattactactttgttagacttcttcaggctaccaacaaattttcctaactatactgcggatagccataagatttcggatatagagcgaggggttagacaaggtattgatggggttaatgtttcgcttttctatccatatattcagcgccacgaactagaggcactcatgtacacgagtatggatgggtttgagatcgtttgtgacgaaaaaagagagttagatcagctgagagcaattgtagagggttacgataatcccgaagatatcaattctggggctgaaacctcgccatctaagcgccttatcaagattttcccaaaatatgagaaggttctttatggagaactgatatttgaggctttggagattgatgctatacgagctcgatgcccccgtttcaacgattggatacaaatccttgaggacggattaaagaaaggatacttttaagccagattttttattatacttttttaagggactttgagctcttgtactcttttcgataaagaatatcgctcaatctatgcttgcaacgcccgacaatgcgtagactttc

SEQ ID NO: 253 - DNA (genomic), 543 bp, PORYPHYROMONAS GINGIVALIS; double-stranded, circular
  misc_feature 1...543
  hypothetical: NO
  anti-sense: UNKNOWN
accaagacatggcgcagctctgtcggtggatgggatatctatatggcacagaaaggctatgccgtctttacggtggatagtcgcggatctgccaatagaggggctgctttcgagcaggttattcatcgtcgtttggggcagaccgagatggccgatcagatgtgcggtgtggatttcctcaagagccaatcatgggtggatgccgatagaataggagtacatggctggagctatggtggctttatgactacgaatctgatgcttacgcacggcgatgtcttcaaagtcggagtagccggcgggcctgtcatagactggaatcgatatgagattatgtacggtgagcgttatttcgatgcgccacaggaaaatcccgaaggatacgatgctgccaacctgctcaaacgagccggtgatctgaaaggacgacttatgctgattcatggagcgatcgatccggtcgtggtatggcagcattcactccttttccttgatgcttgcgtgaaggcacgcacctatcctgactcttacgtctatccgagc

SEQ ID NO: 254 - DNA (genomic), 920 bp, PORYPHYROMONAS GINGIVALIS; double-stranded, circular
  misc_feature 1...920
  hypothetical: NO
  anti-sense: UNKNOWN
ggaaaactatcatcaagactatttggatcataaccctcgcggttattgtcatatcgatccttctttattcgaattggcgaggaaagccaatccggccagattctacaagaaggccgatgatgcagagcttcgtgcccggcttacccccgagcagtatgccgtcacacgcaacaatgccaccgaaccggcttttgacaacgagtattggaatgaatttcgagaaggtatttatgtcgatgttactacaggtgaaccgctatttctttctactgataagttcgactccggctgtggatggccgagtttcagcaagccgatagggaaagagctgatttccgagcgtatcgatcgttctttcggaatgactcgtacagaagtgcgtagtacgaccggcgatgcccatttgggacacttgttcaatgacgggccactggagaaaggcggactccgttattgcatcaatagtgcctcccttcggtttattcccaaagaggatatgaagaaagaaggctatggcagtcttcttcctcttttgaacaaacgatgaggatgctcttgtagcatataatgattcccaatcgtctcagataagactaacgtccaatggcatatctcggaaccaaagccaagtggctgttactactctcctccatcgtgcttcttgcaatagtcggagtctggatttttcaatattccggttatggggagcgattcgaaattgtcgacgaattgggtggcaatatctttccgtccgccatactgtcggtggccacgaccgatgctgaagtaatcaaaccggtcgaaggcctgtacgtgggcaatccgaagtccgttatcagtattcgcctgaaaacgcgaagggccaatagccgtgtgcgtgtggaagtagccgaaacgccttttttctcccagggggatcg

SEQ ID NO: 255 - DNA (genomic), 3218 bp, PORYPHYROMONAS GINGIVALIS; double-stranded, circular
  misc_feature 1...3218
  hypothetical: NO
  anti-sense: UNKNOWN
cacataggagttattcgtacatttgtccgacgagggatgagccgaaaaacaatgaatccaacaacagtgactcagcaattacaaaaaacatatcaggctgtcggggatggactgctgagcgaggcgttcggcctcgtccgtgcatcggtaccctcgcagcaatcgcatttcctcacacgcatcgacgatctggagaacgtctatcggcagctcttgtcatacttcgcccaaggtgtgaaagacgaaaaaacaggccgagatgctcctctacctcaagcgcaaactcataggtctggcagctgaagtgcatcgcgaatccgtggtggcacagggcacggggcttttctacgatcgccttcgttaccgccgcagcatcggtttcgaaagccttgtcaccttgctggagcaggctgagacaagcactgtccgcaagcagttcgacgaattggtacggctcatattcgatagcttgtggacggccgatgctctgacggacgaagaggctgctgccctctcgcatgccggcgaatacattcgcctcgtggcggcgtcggccttgacaatggctctgcaacaacagtggcactcgaaaaagctctacttcctgctcgaagagctggctcgccccgacattacagccgactatcgcgcccgcctgctggtcggagtcgttctcacccttcgttcctatccccaccatacccgactctattataatgagatcgcattgcgactggaagccgtcaatgaacatatccctttggaaccgacccttgagatgctttcgatccgtttcctctttgcctgcgaaacagagtccatcaccaagcatttgcaaaccgagagcttttaagcgatatacagaagatagcccccgacctgcgcaaattcggtatgggagataccgagtccatacaggagacaggcaatccggagtggatggaggagctggagaagagcggtctgggagacaaaatcagggagttctcggagttgcagctcgaaggagccgatgtaatgcactcttcgttcatgaacttgaagggaagcagctttttccgcgagatgcacaactggtttctgcctttcgatgccgcccacagccggatagctccactgctcgaagagaatgctgtgctcaagcagcttgtggaggcgataggcccacagctttgcaactcggaccgctactctttcatcgtttcgatggaaagcctccctgctgcacttcgaggttcggccatgggagccgtaggcggtgaactggatgcactcaaagagcagataaagcaggatgtaccggtcggcgaaaccggcaaattggacacggccatcaagagctatctgcaggatctgtacagattctataaggtatgcgaacggaagaacgaatttgacgatattttcctctcgcccatcccaccggatctgcctgtgctcgatcgctatctctacaagcgtgatacgctgctgcatacggccgaatttctcttccgccgcaagcattacgatcgggcagcgaagcttgctggccgatttggctgaagggaaagaaagtgccacggataccactctgcaccaaaagctgggtttctccctccagcagcagggccttttcgcccaagctttggctgcatattcgcgtgccgaactgatcgatacggagaacgaatggctgctcaagcgtatggctcactgttaccgccagctgtgccgtccggccgaagcggccgaaatatatgaacgactcttcgagcgcaatccgcacgaagcgactctactcctgcagcgaggaaatgcgctcgtcgaggacagccgatacgatgaagctctacaatgcttcttccgatatgagttcagtgtggacgatgcttccaaggctcgtcgtcccatcgcttggtgcctcttcctcaccggccagtacgaacgtgccggcgattactatcgcaccatactggaatccgacgatctctcgactttcaccgatcggctcaatgccgggcatacgtctttggctatggggcagatccctgttgcgatcgaccattatcttgcgggattgaagctcactccgacgggaaagatgaatttctcgcagcctatacggcagacataccggttcttctcaaagccggtatcgaggatgccgtcatcaggctcattccggaagtattgaggctacacccgactaagggaattactaatgtttcatctcacaaacctccatcaatgagtaaaaaatttgtttttgcaatcagtattatggcaatgctcacagcatgtaacggcagccgtaaaggagatgccaacctctccgacaatcctctgctgcaatcgagtgctctcttcatggaagcacccgaattcgacaaaatcaaaaccgaacacttcctgcctgctttcgaagccggcatggagcagcagttggccgagatcgattcgatcgtgaacaactccgaagctcccactttcgagaatacgctcgtagccatggaacgttcgggacagacactcaaacgtgtttccaatgtcttcttcgggtctcacgggagccaatacgaacgatgaactacagaaaatcgaagaaaaagtatcgccccttttggctgcacacagcgatgccatctaccttaacgacaaacttttccaacgcgtaaaagccgtttacgaaagtgaccaatccgccatcgaacccgagggacaaaagttgatccaagagtattacgatgcctttgtccgtgccggtgccaatctgagtgccgaggacaaggccaagctcatggaactgaacaaggaagaggcttcgctgacgaccgaattcggcaacaagctgatcgcagccaccaatgccgcagcggtaatcgtagggagcaaagactcgctcgatggtcttagcgaaacggagatagccaaagctgcaagcgatgccaaagctgccggccacgaaggcaaatacctgttgaatatcaccaataccactcagcaggattatctctcggtactgaacgaccgtaccattcgtcagcgtgtattggaggcctctatccatcgcacggacaaaggcgatgccaacgacacgcagtccatcgtacttcgtctggccaggctccgcgcacagaaggctcgccttctcggcttccctaattatgccgcatggaagcttcagaatcagatggctaataatccggagacagtgctggcttttgtccagtcgatag

SEQ ID NO: 256 - DNA (genomic), 6305 bp, PORYPHYROMONAS GINGIVALIS; double-stranded, circular
  misc_feature 1...6305
  hypothetical: NO
  anti-sense: UNKNOWN
ggaggtttgggctcttgaagcatttggagcttcgcatatcttgcaagaaattcttactgtgaaatctgacgatgttgttggacgttcaaaggcatacgaagcgatagtcaaaggagatccgatgcctacaccgggtattccggagtcgcttaacgtgctattgcatgaattgaaaggccttggtttaagtttttctttggactaacttctaaccgagagtctgtacaattatttttgccttcatccattcctattcaagcaaagtgaactatggcttttagaaaagaaaataagataaagaacaacttctcgaagattcgtatcaccttggcttctcctgaagagattcttgagaactcattcggagaagtattgaagccggagacgatcaattatcgtacctacaagccggaacgaagatggcctattctgtgaacgcatcttccggtccggttnaaggatttttgaatggtcactgtggcaaatacaagcgtattcgataccgtggtatcgtatgtgatcgctgtggagtcgaggtaacggaaaagaaagttcgccgtgagcgtatggggcacatccatttggtcgtacctgttgctcatatttggtatttccgttctcttccgaataagatcggctatttattaggactacctaccaagaagttggatgccatcatttactatgaacgctacgttgttattcaaccgggtgttgccgaagggttgagtcaacttgatctattgtcagaggaagaatacctcgacaagcttgatgaaatagagcgcactcacaagggcaaccaaaatttggaggataccaatccggacaaatttattgccaaaattggggcagaggctatttatgatcttctatgtcgtgtggatctggattctatttcctacgaattgcgagatcgtgccaatacagatggttcgcagcaacgtaaaacagaagcacttaaacgtcttcaagtcgttgaaagtttccgtgcatccaaaggtgtgaatcgtcctgagtggatggttatgaaagtgattccggttatcccgccggatcttcgtcctttagttcctttggatggtggacgtttcgctacttccgatctgaacgacttgtaccgtcgcgttattatccgtaacaaccgtctcaaacgattgatcgagatcaaagctcctgaagttatcttacgcaatgaaaagcgcatgctacaggaagcggttgactcccttttcgacaactcgcggaagtcaagtgcggttaagtctgacaacaatcgtcctttgaaatccctttctgatagtctcaaaggcaaacaaggtcgtttccgtcagaacttgcttggtaagcgtgtcgattattctgctcgttccgttatcgttgttggtccggagcttaagatgcatgagtgcggacttccgaaagacatggcagccgaactctacaaacccttcatcattcgcaagttgattgagcgtggcatagtgaagacagtcaagagtgccaagaagattgtagaccgtaaagagcctgttatctgggatattttggagtacgtgatgaaaggacatccggtccttctgaaccgtgcaccgactcttcaccgactaggtattcaagcattccaacccaaactgatagaaggaaaagcaatacagttgcatccattgagttgtactgcatttaatgcggacttcgatggagaccaaatggctgtacaccttcctctgagcaacgaagctattcttgaggcgcaattgcttatgttggcttcacataacattcttaaccctgccaatggagcaccgattaccgttccttcacaggatatggtattgggactctattatattaccaagctacgtcccaataccaaagggcacggcctgattttctatggccctgaagaagcgacaatagcctataacgagggtaaagtcgatattcatgcgccgattaaggtctatgtagaggattacgagaacggagaacttgttcgtcgtatggtagagacatccgtagggcgactgatggtaaacgaatatgtaccgaagaaggtaggctatgtcaatgaagtactcgggaaaaaagctctacgagatattatcggtagcgtaatcaagatctgcggagtagctacaacagccaaattcttggatgatatcaagaatttgggttactacatggcttttaagggtggcttgtctttcaacttggcagatgtgcttattcctgatgagaaagaccaattgatccaagaaggttacactgccgtcgagcagattatgcaagactacagtatgggattcatcacctttaatgaacgatacaatcagattatcgacacatggacacatatcaatggccgtttgtcaaatgttctgatcaagcaactcagttcagacaatgacggattcaactctgtcttcatgatgatggattccggagcacgtggttccaaggaacagattcgtcagttgtcaggtatgcgtggattgatggccaagccccaaaagagtggagccgaaggaggtcagattattgaaaaccccattctttcaaacttcaaggaaggactctcggtacttgaatactttatttctactcatggtgcacgtaaggggcttgccgataccgcattgaaaacggcagatgctggttatctcacccgtcgtcttgtggacgtttctcacgatgttattatcacagaggaagattgtggcacgctacgcggactgcttactaccgagctaaagcaaaacgaagatgtcgttgcttccttgtacgaacgtatccttgggcgcgtctctgttcacgatattatccatcctactacaggggatataatcgttagagctggagaagagatcagagagcaggcagcacagattatcgaagattcacctatcgaagctgttgaaatccgttctgttctcacctgcgaatccaagaaaggagtatgtgccaagtgctatggtagaaatcttgctaccaaccgcatggtacaacggggtgaggtcgtaggcgttattgcagctcagtccattggagagccgggtacacagcttactctccgaacattccacgtcggaggtatcgcatccaatgtggcaacggagaatagcttgctctccaaatatgatggtatcttggaattcgaggaactacgtgctgtggatgtaacagacgaatcgcatcaggtcgtagtgagtcggatgactgaattgcgtattgccgatccgaataccggtatcattttggccaatcacaatatcccctacggtgcaaaattgttcttccgccaaggtgatgcagtcaagaaaggtgacaaaatcatcgaatgggatccgttcaatgcggtcatcgtatcggaagtagcaggaacactctctttcgaaggtgtagtggagaatgtaactttcaagatggaaagcgacgagacgaccggtctgaaagaaaagattatcatcgaatccaaggataagacgatggctccctatgctcgaataatagacgagaatggagagatgctcaagaactatagtctcccgatgggtgcccacgttgtgaaagacgatggcgacacagtcaaagttggcgagattttggtgaagattcctcgatcagtgggaaaagccggtgacattaccggtggtttgcctcgtgtcaccgagctattcgaagcacgaaatccgtcgaatcccgcgatcgtttccgaaatcgatggggaaatcggctttggcaagttgaaacgaggaaaccgtgagatcactgttacctccaagctgggtgaagagaaaaaatatctaatccccttgtccaagcagcttcttgtccaagaaaacgacttcgttcgtgcaggaacaccgctttctgacggagctattactccggctgatattctggcaatcaaaggtcccacggcagtacaggagtacatcgtcaatgaagtacaagacgtgtataggcttcagggtgtgaagatcaatgataagcacttcgaagttattgttcgccagatgatgcgcaaggttgaaattgtcgatccgggtgacaccctcttcctcgaacagcaggtagtcgataagttcgaagtaatggaagagaacgatcgcatctggggtaagaaggtagttattgatgccggagatagccaagtgctgaaagccggacagattgttacggcacgcaagctccgtgatgagaacagtatgctcaagcgtaaggatctcaagatcgtgaaagtgcgcgatgccaagtcagctactgccagccagatactccaaggtattacccgtgcggcactgcagaccaagagcttcatgtccgcggcctctttccaagagacaaccaaggtgctgaatgaagcagctatctgtggtaagactgactacctggaaggactgaaggaaaacgttatctgcggtcacctcattccggccggtactggtttgcgcgattacgagaagctcgtcgttatgcatcgtgacgattacgaaaaggcgacagccgagcgtaagagtttcctttccgtgcccacagccgaaccggcaatggaagaagcaccatcggaatagttccacagggtaaatagcctcaaacgatataatcagggctgtgtcggaggttttctcctttgacactgctctgattattttattttttactgatttccggataagtaacctccttattttgtggttattccgactttcagacttatttttgcaatatacaaggatggaagatattgatagagaagcactttcccctcgattcttcgccggatctcataataatagttctacggcctttcttcctcgttgtacggatttgagcaaatagacattctctgaacacttatatgtggaagacagcttcggataaaggattgggacacttgcttagagatgtttggtctctgctgaacgaagaggaacgagagctattagacaaggagatacaaccttttccttgtaagaaagcctccaccgtcttctctgaaggagacatccccaacaatcttttttatctgtacgaaggaaaaataaagatcctgagggaaggcgtatatggacgcttccacatttctcgcatcgttaagccggggcagttcttcggtatgcgtccttattttgccgaagaaacttgttcgtccacagccattgccgttgaaaactccaaagtccttgccataccggtcgaagctatcgaagcattgctgaaaggaaacacctcattctgtagatacttcctcaaggccttggccaaagagttgggctatgcagaaaggcgaaccgtaacgctcacgcagaaacatgttcgtggccgactggccgaaacgctactgatactgaaagagaatttcggatttgagaatgatggagctaccctaagtatctaccttagtcgagaggaactggctactctttccaacatgacagtaagcaatgccatacgtaccctttctacattcgtttccgagcgaatgctggcacttgatggcaagaggatcaagattatcgactgcgatcgtctgcaaaaaaccgcacgttccggttaaagtctcccccccccttttttcgatagtcattgaaggagatcgacaaagacctataagaaaactatttgtcgaatcagttctgcatccacggccgtattcagcctgaggagcaactctgctttgttgttgctcagctggctgcgaacaacggacgaattgaatgtcaggtacagtacgccgtcatgaatcggctacgaccgaggaatttatagagaggccccaacacctgtggcaagagcttccaaagcttccacctcgagaagtcgttcatacatgagcggttcatcctccagccaagcccgaattacctgatccactttctgtatttcgcttttttccatccaaggatacctattattggaatatctgtccgttttctattttgaaaaggcggtaatcctcactccaagaagcgataatctcgtccaagtttttccgattcgtatctgtgatgaagatctgcccgaaaccgttaccgccgacaaggcggataatccgctccacacgggtggcatccagtttgtcgaatatatcatcgagcagcaaaatgggcgtctcatcaccgtgcagttgctgatggcggaactgtgccaacttcatgctgatcaggaaagtcttgttttgtccctccgaacctattttccgaataagaactccaccaagaagcatttccaattcgtccttgtgtacaccgcaagaagaaaatcccagcaaatagtccttggggcggctcctgcgaagc

SEQ ID NO: 257 - DNA (genomic), 3449 bp, PORYPHYROMONAS GINGIVALIS; double-stranded, circular
  misc_feature 1...3449
  hypothetical: NO
  anti-sense: UNKNOWN
gatccccgtgtgccaattagtcaatagaaaagcttccccgaaacatccacagtcggccaccgggttgaatatggccaaatagagtgtaagcggagtcatgacagccataaagagaaagatgaagcgagctgccatgcgtctgtagatacccatcaagagaaatgctcccacgatgaactcactacagcaaagcaaaatgctaagaataagggataagccctcggacttaggcaaagcaaaaacagtaaaatactcactgattttgatcgctcctccctgcggatcgatagccttcagaaagcccgaaacaacgaaggtcagacctaatatgattcgagaaagctcagcaaggaaacgtttcatccgttcaactgtatcaatgcgaagatggcatagttgatcatatccatgtagttggcatccaccccttcggatatatatgtatcacctccgagatcttctatctctttagtgcgaaataccttagtcagaatcaagtcggcaaaggatgacacacgcatctgtctccacgcctctccatagtcatgattcttatcaagcatcagcgacatggcttcacgaatcttgaggtcatacaggcgcagagcttcctctgtctccatcttaggtgtgtcagctactcccagctccaattggatgagagctattactccataattgacgacacctataaactcagactccactccttcatccaccttactcaaacctttcatctgaatatttcgaatgcggttggccttgatataaagctgatcggtcagagacgacggacgcatcactcgccacgaggctccatagtcgtgcagttttttctgaaaaacctcacgacaaatatcaatcacgtgctcgaactgctctactgtatttggcttggctgtagtcatttctttctttgcttcttctccgttttttccactttttcggttttctcctcctcggtcttcttgccaaaggaatatatatcggtggtatcgatgactttctcttcgagcaaagcttctttcaacacctcgttaatgttggacacatagtggaacttcaagcccttcagatagatatcgtttatctcctctatgtccttgcgattctcttcgcacaggattatttccgtgataccggaacgtttggcagccaatatcttctccttgattccacctacaggaagcacctttcctcttagagtgatttctcctgtcatggcaataccggcccgcacttttcgacgggtaagagccgacaccagcgaagtcaccatcgtaatacctgcactcggaccgtctttcgggatagcaccttcgggaacatgtacgtgtacctgccaattattgaaaatttcctgagagatgcccaactcatcactatgggcacgaatataatccaaggctattacggccgactctttcatcacatcgcccagattacccgtaagcgtgagcttcggttcgcgtccgcggtgcagactcgtctcgatgaacaggatctcccctcccaccgaagtccaagccaatccgatcacaacgcctgcatcgccattgccttgatagcgatcgcgcgtatagcggggtgctcccaagaaagtaaccaagtcggacggttccaccttggtagtatgtaccacattcgtggcggcctcctttgttatcttacggatcacagctgcgatctgcttctccaacgtacgcactccactctctctggtgtagtcgtcgatcagcttttctatggtttttttggagaacttgatgtcgttctttctgaatccatgctccacaagttgctttggaatcagatggcgggcagcgatctccactttttcttctatgatataaccgctcacatcgatcagctccattctgtccaaaagaggacgagagatactgctcaaactgttggccgtagcgataaaaagaacatgactgaggtcgaagtctatatccagataattgtcatgaaaagcattgttctgctccggatcaaggacttcgagcaaagcagaagaaggatcgcccttgtagtcgctgtcgatcttggctatttcgtcgaggacaaagacgggattagatgtacctgctcgctgcaaactctgaatgatccgtccgcacatagcaccgatgtaggtacgtcggtgtccacgaatctcagcttcgtcatgcaagccccctaaagaaatgcgtacgtatttacgacccaagctctcggcaatgctcttgccaagagaggtcttacccactcccggagggccgtacagacagatgatgggcgacttcatatcgcctttcatcttgaggacagccagatgctctatgattctctcttttactttctcaagaccgaaatgatctctatccaaaacggattgggcacgcttcaggttgaaattatctttactgaatacgccccacggcagactgatgatggtctgtacatactgcatctgtacggagtagtcgggcgattgaggatgtagccgttccagcttgcggagttctttttcgaaagtttctgctacctcgctgctccacttcatcgtagcagctttggtacgcagctcctgcacctcgatgtcgtttatattgccacccagttcctcctgaatcgtcttgatttgctgctgcaggaagtactctttctgctgcttgtccatctcctcgcgcgtcttcatctgaatagaagctttcagttccattacctgaagctccttgtgcaacaggtagagaagacgatagccacgatccttcatcttgctgatttccagcaattcttgcttgacggctatgctcgtggatatattggccgatgcaaagttgatctgatacatcggattcttgttccgtctcatcgagaggataagctcccgagggggtctctcgaccatcagctccatcatcttcagactcatatcctgtatggtggagacgagtgcttcgaactcgtgatctttgttcttcccggggagaatgtctgggagcagcttcacgcgacccttcataaaaggttccgtagccgttatctcctgcagtgcaaatcgctggcggccttgtacgatagccgtggtagtaccatcgggcatctccagcaccctgatgatttcagccacgaccccgacatcatacaaatcggcacgatccggttcctccacatccatatcgcgctgtgaaacggcaccgaaatagacacccttcttctccacgtagcggatcagcttgagtgatttttctcgtccgaccatgataggcatggccacaccggggaagagaatcatattgcggagagccaaaatcggcatctcctcctgcatatgatcttctttcacctgaaatcctcatcttcttcacaaacggaaagcaccggaaagaatacggggaaccatcatcctcgtcgtcctctccaggcgtatatatttctatcatcatctttagtcttcg

SEQ ID NO: 258 - DNA (genomic), 372 bp, PORYPHYROMONAS GINGIVALIS; double-stranded, circular
  misc_feature 1...372
  hypothetical: NO
  anti-sense: UNKNOWN
cagcaagctgagatcgtttggcgcgcaagcgtgcgatacgcttcgtctttggtataatggtagcaatagctcaagagacgcgctccaagcagagaagcattaaagaccgtatcgttgccatccaaggggctatacgaaaacaggaagccatctctataagcagtacgatgtagatccttaatcacaaattgagccgccgagagagcaacatcaagatactcctgttggcgtgtaacctcatacgcctccatcagagccgtagcgcagaaattcgtagccacaaccgtcggcgtatatttagggaaaaggaaaagtctgcgcgcttgccaatcaaaattgtacccccagcaagccccactatagtcaccagga

SEQ ID NO: 259 - DNA (genomic), 680 bp, PORYPHYROMONAS GINGIVALIS; double-stranded, circular
  misc_feature 1...680
  hypothetical: NO
  anti-sense: UNKNOWN
aaacacataccaccatgaaagttaaatctaccggcgcatcggcacggnaggatgtattcccattccgagtccatcgcgtcaaagaagtagccgtgcgctactttccgcaccttactccgaattccggtacacgtgctctgcgaagaatcatctatggggatcaagatctcctcaattcgatgagagaacatggttatgctctgggacagagatccttgacaccggctatgctcaacgtccttacagcctatcttggttcgcccgaagatttttgtccttgacggacaatagctgaaagtctgcttatagggggtatgtcgaagtcgtgatttgcggctttcggcataccccctttcagtatatgcaaagaggatgtttagatgtgagaggtggaaaggtattcggcaaaggcggctacattctccgatggagtagcccatgaagtgaccagacgaatggctgagctgtcgggtgatacggcttgccacacgtagaagtcgaatacggttttcagtctttcgatcagatcgttggggaggatcgggaagatctggttggtttgcggagggtagaggaaggaataaccgcagaaggagatagctgtcgccagatctgctgccattctgttggcatgagctgcaagccggtagtaaagcccatcgcggaaaagcgtggcaaac

SEQ ID NO: 260 - DNA (genomic), 599 bp, PORYPHYROMONAS GINGIVALIS; double-stranded, circular
  misc_feature 1...599
  hypothetical: NO
  anti-sense: UNKNOWN
aagaagcatttccatctgacgctgcatgcggctgcttctccggcaagctttagcagcaaacccctccgtattatccgcatagatgatactgcgcgaagcattgacgagcagaccgcaatgagcattcatgccgtactcggccacatcttccagacttccaccctgagcacctacgccggggacaagcaagaaagcgtccggcacgatctcgcgaatatctttcagcatggaggcctgcgtagcccccaccacatacatcagttgaccggcattatcccacgtctggctgatacgaataacgcgttcgaaaaggtattctccatcggcatcgcgcatcatttgaaagtcttgcgaacctttgttcgaggtcagtgccagaagcaccgtgaacttgcctgcataactcaggaaagggctgatgctgtcctctcccatataaggagaaacggtgagggcatccaccttgagatgctcgaagaacgaacgggcatacatatcactcgtattgccgatatctccacgcttggcatcggctatgataaattgatcggggtatcgctctcgaatgtattcgatcgttttttcaaaagagtgagctc

SEQ ID NO: 261 - DNA (genomic), 960 bp, PORYPHYROMONAS GINGIVALIS; double-stranded, circular
  misc_feature 1...960
  hypothetical: NO
  anti-sense: UNKNOWN
acgcatcccgtcccatcagcatacagaggcgtatgtacacccctcgtgaagggaacttccaaggctgtctatgtagccaacggaancagaggagggaagcataactacggagtcgctgtagatcttaccatcgtggatcgtgatggaaaaccgttggatatgggcactcctgtcgatcactttggccgagcggcacatgtgggtcaggaagaacgcttggccgcagacggcctgatcagccgagaggctgtccggaaccgccggttgctacgtcgcataatgaagtcggtcgggctggtaccctatcgcagggagtggtggcattacgaactgccggagagcatgagccacacccgctcacattatcgcttgctcgacttttaatccttgttcttgtttgccgagaggtctgcaatgcggacatcatggaaatacgaaccaaaaatcctccgattgcggctcgtgtttcctgaaaaagtggcgtgagatttttttcgttttggcgtgtaaattctttaattgccgtgccaaaacaaaaaaattctcgcgccatgtttttgtggggaacaaatgcgaaaattccggnacgcaaacctaccggatatgaaatgatgtattccgttgtacttgagaccggagtgtgcaggattcttctctccaaaatgtacttcgtaagtgtaaattagcttactttgttaagtataaacaaagtagtacagtcggaaaaataaagtatcacaatactcactctaagttaaaattatggcaaaagaaaaagaaaagctcttttccgaattccctccggtttcgagagaagcctggatcgataagataacggccgatctcaagggggttccctttgagaagaagcttgtctggcggacgaacgagggctttaatgtcaatccgttttatcgcagagaggacatcgaggatctgaagacaacgacttctcttcct

SEQ ID NO: 262 - DNA (genomic), 924 bp, PORYPHYROMONAS GINGIVALIS; double-stranded, circular
  misc_feature 1...924
  hypothetical: NO
  anti-sense: UNKNOWN
ttggaaaatgaaagggaataagtttgccgtcataaacctaacgattgctacgttcggttatcaaacaagtacgaattaatgggacctttgcacaatgagcaggcacttttgtttattcttcttattgtgtgtcaggcgactatttggtacacgccgaatttccacaagtggaaagctatctttccaccagtggaaagttttgtttccaccagtggaaaaagaattttccacttgtggttttggcgaaaagttccataagtatagaatgagagctatattgtcttcactttcccaatctcttgggtcgaactcacattcgtgaataaaccgttttctaacagatactatccggctgctattgcgtacttttggggcaaatcagtacaaacagcatggataagaaatcttttcaggaatattatgccaccggctttagccattgctatggttgtggcacatcgaacgagcacggtctgcacgtaaagagttattgggcggaagagcatccggatgagacggtagcgtatttccgccccgattcacatcatacgggaggattccccggctttgtctatggagggctgattgccgctatccttgactgccatggcaatggtaccgcagccgctgcaggttatcgttttcaaagtcgcccgatggattcggagccgaatctgagatacgtgacagctaatctgaatctcaactatcgccgtcctaccccgatgggagtagacttggagctacgcgcccatatcaaagaggtaacggaccggaaagtactgatggagctatcgctcattgcagaagggcaggtaacggtggaagggagcatgctatccgtcctgctgcccgaaaagaagtatgccaagcaaacggagagggcaggatataaaacgcgctttgcgactcaagcatagacgg

SEQ ID NO: 263 - DNA (genomic), 8722 bp, PORYPHYROMONAS GINGIVALIS; double-stranded, circular
  misc_feature 1...8722
  hypothetical: NO
  anti-sense: UNKNOWN
agattcaggatgctcgctatctgttggtattcaaatgtaccaaaccccnatatccgcaatcggatcacaccggaatcaataaccagaaaacatataattatgagtgtaacgaacattatcgatgacgaaagggttactatcgtacaaggcgtaaacggcatcctgctgtgtcaggaatcgtggatggcaggcaaaagccccagatgggaccgaaaccatcccaacgcgattgacgacacggaagccgatgggccgagctcaatatgaacgagatcggacaataaaaccaacccttaaaaagtatgcaaaccatcatcaccacattcatccttttatttagctttgcgaagtgctctccctctcctattccatcttcaacgagaagcgactgctacgcaagggcgcagtacagtatggcaagctcaattcgcttttcctcaccctggctcacatagcctattacttcacttccctgtacgaagcgtatgccacgggagtcgagttcaatacgctatccggctggggcgtagcgatcttggtttttgcctatgccatgctcttcttcgtcatctataagctgagggatgtgtggacgctgaagctctatatcgtacccgatcatcgtatcgaaacgagcttcctgttcaagacggtacgccatcccaactatttcctcaacgtcattccggagcttatcggtatcaccctcctttgcaatgcttggattaccttctgtgtcggaatgcccgtctatctcgctatcctcttcgttcgtatccgtcaggaagagcgcgccatgaagcatctatgggcgacggtacgatagagaatgattttgggcaaaaaggcctaaaatacagaccgaaaaagttttcaacaacgaagacgagtttggaatcattccaaataagcacctgaaaggaaggagatcctgaagtaaaaaagcaggaaaagcgaactttttcagttcggaccatgctttcaaactctttgcaaagcgatctgtatatagatcaaaaacgatttatatacagatcgttttcgttttatatacaaatcgttttccatttgtatacagatcgtatctgatttatatatagttcggacggctcaaaaggcccattcccgagcttatataaaagaggcacgcacccgattccaccacgaatcgagtgcgtgccttatctgtttgcaggtcttgcgaaaagttttatcgcctatgcttcatacgccctgtccgtcttcctttggataagcgggtagcatgtagatgaatgcaccggagcgatctgcccgggtgcgttggtcgtatgagcgaagtcggagtacatgttgctgatcattgagtcgtttcgttatgctgttctgccggtggaatagctctgatatatagccgtttatcttttgtgtggagctttcctcggcttgcaaatgtagcaaaaaagcccacatccgatgaatcgaaattttttggagaacaatctcatcctttacgggataatcacattgcttctgtttgcttgcaagagcttgatttgtaaatgcttgatagccagccgatgtctttattgtatttccactgagtaaaaatactcacatcattgagtaaaatgtatgggcaagtataaaagagctaagtaccgctattggctttttcctttctgttcggattattatacctttgagggagttacttttttatgcgcatctgacgatatgacaaccaagaaaccccaagccattttagacttagagaaggcctataacattgaaattcctgatctctcctcacaagaagggataagctggtcggtaaatagatatttcaagcaagattcctccggtgcagtcgttgagctttgcttgcgagaatgtcagatagaaagcatgacttggcttattgattttcctgctctaaaaaagcttgatctatcgtataaccaaatcagtaagctagagggtctagaacgtcttacttcgttaacaaaacttcgtctaagaagtaaccaaatccgtaaactagagggcctggatagtctcacctcgctaacaaaactttctctctccgataaccaaatcagtaagctagagggtctggaacgtctcacctcgttagcggagctttatcttttggataaccaaatccgtaagctggagggtctggaacgtctcacgtccttagcaacgcttgaactatcgggtaaccaaatccgtaagctggagggtctggaacgtctcacgtccttagcaacgcttgaactatcgggtaaccaaatccgtaaactagagggtctggaacgtctcacttcgttaacaaagcttcgtctaagaagtaaccagatcagtaaactagagggcctggatagtctcacctcgctaacaaaactttctctctccgataaccaaatcagtaagctagagggtctggaacgtctcacctcgttagcggagctttatcttttggataaccaaatcagtaaactagagggtctggaacgtctcacgtccttagcaacgcttgaactatcgggtaaccaaatccgtaagctggagggtctggaacgtctcacgtccttagcaacgcttgaactatcgggtaaccaaatccgtaagctagagggtctggaacgtctcacttcgttaacaaagcttcgtctaagaagtaaccaaatcagtaagctagagggtctggaacgtctcacgtccttagcaacgcttgaactatcgggtaaccaaatccgtaagctggagggtctggaacgtctcacgtccttagcaacgcttgaactgtcgggtaaccaaatcagtaagctagagggtctggaacgtctctcttcgttaacaaagcttcgtctaagaagtaaccagatcagtaaactagagggcctggaacgtctcacctcgctaacaaaactttctctctccgataaccaaatcagtaagctagagggtctggaacgtctcacctcgttagcggagctttatcttttggataaccaaatccgtaagctggagggcctggaacgtctcacctcgttaacaaagcttcgtctaagaagtaaccaaatcagtaaactagagggcctggatagtctcacctcgctaacaaaactttctctctccgataaccaaatcagtaaactagagggcctggaacgtctcacgtccttagcggagctttatcttttggataaccaaatccgtaagctggagggtcttgatggtcttgcttccttaacaaggcttagtctaaggcgcaaccaaatcagtaagctggaaggactagacagactaaaggttttgagaaaacttgatgtttcgggcaatgatattcaatctattgatgatattaagctattggctccgattctggagcaaactttagaaaaactgagaatccatgacaatccatttgttgcatcatcaggcttgatactctctccttatgataatcatttgccggagattaaagctcttcttgaaaaagaaaaagaaaaacagaaaaagacttcagttgaatatcacccattttgcaaagtaatgctattgggaaatcattcttcgggtaaaacaacatttcttagtcaatacgatacaaattatacgtatcagaaaaatacacatgtgttgtcgatacatcgaagcaataaccctaatgcgatcttttacgactttgggggacaggactattatcatgggatttaccaagccttttttaccacccaatcgttataccttctcttttgggatgctaagaaggatcgaaactttgtgagcgtagatgataaagaatatcagactcttaatttcaatcgcccctattggttaggacagatagcctatgcctgcaatcgttgtatgtccgttggaggaaatcctgatggcaaggacacaccacagaccacagacgatacaattatcattcagactcatgccgatgaaacgggcgctaagcagcaaaccttaggctgtgcagccgagaatggagtattggaagaaatctatgtatccttagagcccaaggcgaatagtgccgtacatgcgctcaactatctgaatgagcgggtgcgagaagttgtcgcaagcaggagtaaatcaattcagatcacagaaaaagataagggattgtacgaagctcttcccacaatcgccggtgataataaacacatccctatctctctcgaagctcttgcggctcaattgaataagggaagagctgaaaatgatctttacaccatagagtatctacagaccgaattgaaccagcttagtctgcgaggggaggtgctttactatcgtgagaatgagaagctgaacaattatgtctggttagatccggcagcttttgtccaaatgattcatggagaaatcctccaaaaagacaacatcaatagaggaacagttcctaaagacatttttgaatgcaaactgcataatctaagttccggaagtatatttgaagaagatggccaaaatggtaatatgatcttgcagctattattggaagagctgatcgtatatgaagataaggactgctatgtgataccgggctatctccctttgcattccgatgacgaagcctataaatggcttactttgggattcgagaggcccaattttgtcctcaaattcgaacgttttatcccctttggcctgatcaaccagattatagcctactatggccgggaagaaggtgctctaaagcggtattggcgagatcaggtcatcttcacagcaggccgtgagatggataggcaaacgcttgagcaagaagaagagaaagagggtttgcccaagacgaatgccgaggattatcagatctggatcaagctcgactttaccgacttggccatatccgtattcatcaaagagcagagaaagacatcagctaaggatatgcagcggaaagaggctactatcctcagtgatatgttggatatgtattggancaatatccctccgagggagcaaataggagataaggatacggagcaaacgagaagcactattcgtgaaacaaacagaaagaagagacccatccaggatctctacctctcctgtgcccaagcggataaagatttgacggagtctcattatatccatttgggcacgctggacgatgaaagcaagactacggcgaggattgcagcctatccgttgaagaacggcgttatcgataaagagcgggtgcgagaagtatcgactcgtccctacaaacatctttccgtcaataaaaatctggctactgcaaaacagatctttatttcctattccaaagaggatcagactgaactggagacctgtctgcaatttttcaaacccttggagaagaatggtcagatcgagatctactatgataagttgactaagtttgaaacacctattcaccctgaaataagaaagcgtattgtcgaagccgactgtataatcgctttgatcagccaacgctatctggccacggattacatcctggatcatgagttgcctgtatttcgggagtataacaagaccatagtgccgatattgatcaagccttgtacattcgaagacgatgagttccttcgggagaaatattttgctcagaaagctcaaataatcaatcttggaaaagagggaaaaaccattaaagcttatgatagtattacggcatcagcccatcgtgatgaaaattgggtggcagtagtcagagagttcaaagagaagatattaagaataacaaaacaggaggtaaatacagatgaataaggaagaatgcaagcgtcagcacttggatcatgtgcagggcgtcattacccgtatggcgggcaattcgtttcagatcaaaggtttttgtatggctatggccaccattctcggagccttgtatgcggcgaacttccgctgtgagtagatgattgtattggcactgataagcgcggcatgtgccttggtggatgctttctacttgcaactggaaaggaagtatcgcgagctatacaaacgaagcgtagcaaaaatggaggaagaccgtccgcacaaggaaatctacgatatggatgttcgtaagatcaagatgaactattggcgttgcctcttctccaagagtctttggatgccttatgggatcatactggctcttttgttgatttggcttttcctctcatgcttgcatccttgcggactgccgactatctgctgcaaataagccggaagtggaatgaagaagatcgtgatagccatagactccttcaagggttgtctctcctctgccgaggcaggagaagcaggcggtatgggaggtgggctgttggcttcacaccccgagcgattatccctcggggtattttttgtttatagggtgttgcatttactattggaaaatacatgataatctcaccctttatgggataatcacattgcctttattgacttgtaagagattgattatgaatcaaatgtctttattatatttgcactgagtaaaaatactcactctactgagtaaaatgtgcggatatgtataaaagagcagagtatcatgtgattacagatcgtcttaaagatcggaggagattcattcaagtcgtaatgggggctcgtcaaatcggaaaatcaacggttgtcaagcaggtgctgaaggacttggatgcaccctatcagttcttctcagccgataatgttccgactgtgaacggtgcttggatttccgattgttgggctgctgtccgtagcctgaaggaggccaaggagtgggagagcattattcttgtgatcgacgagatacaaaagattgctaattggagtgaagtcgtgaaaaaagagtgggacgatgatacgttccatgaccgtaatatcaaggtgttgctgttgggcagtagtcgtgtgttgttggaaaaggggttgtcagagtcgctggccggtcgattcgaagaaatacgcatgagccattggagctatcaggagatgaaagactgcttcggtttctcgctcaaccaatatctgttttatgggggatatcccggtgccgcttccctgaccgatgatgacgaccgtttcagccaatatattcaagctgccattatcgaagcaactatcaataaggacattctgatgggtacaccgataggtaaaccggctttgcttcgccggactttcgaattgggggctgcctattcgggagaattactttctttgaacaagatgttaggctcactccaagatgccggtaatacggtgaccttggccggatatatcaatctgttggatgaaagcggattgctttgtggacttcagaagtttggttatgatatggcaaggaggaaggcaagtattcccaaactgcaggtctataacaatgcattgaagatggtgtatagcccttttacctttgaacaagcgatgcttgatcgcaagtcctgggggcgaatcttcgaatcaggcattggagcctacctcgtcagtcaggcttttgttcatcgtttcgaggtattttattggcgcgaacgagacgatgaagtcgatttcgtcctgcgcaagaaaggttctgttgttgccattgaggtgaaaagcaatgcagagaaaaggacagacgggctggacaaattttcccattccttcaagccccaatcggcttttattctcggagatggaggtgtcagagccgaagacttcctttcgatggatatacgaaagttattctgagtgtcgctgtttttttgcgaacagcacaataaaaaattgatgcacttaaagagtcctttccgatagcaatctccacctgataccggaatttgtcttttccggatacaggtttacagaatgagagcaaaaacctaagagccattcgagttagtttgtctatcgttttttctcttgggttttggaatttttgtttggatgctttgcagtgcttccggattttgttgtaaactaaatgcggaatgaagaagatcgtgatagccatagactccttcaagggttgtctctcctctgtcgaggcaggagaagcagctgctgagggcgtacgggcagcctgtccgattgcagaagtaatggtactgcccgtagctgatgggggagaggggatgcaggatgtactgatagctgccacagatgggcagcgcatagccgttcgtgcacactccccactaatggaaatgcgcgaggcttcttatggtatatccgctgacggacagacggctttcatcgaaatggcgagcatcagcggactgcctctcgtgccggaagaccggcgcaatcctatgcagactaccacgttcggaacgggagagctgatcaaagatgctctggatcgaggttgtcgtaagtttatcgtcgggatcggtggcagcgccaccaacgatgccggactggggatgctacaggcattgggctttcgcttctacgatcgggatgggagagatataggggagggcatggccctatgcggcggtttgctgtcggaggtctatcgcatcgatgactcttcggcacatccggctttggccgattcgctttttacggtggcctgcgatgtgcgcaatcctttttgcggccccgaaggtgccgcttttgcctttgctcctcagaagggagcggatgaggagatggtggcccgattggatgattcgatgcagcatttggctgccgttatacaccggcatacggggcaggatatagtccatatcccgggagctggagctgcaggcggtatgggaggagggctgttggctttcctcggagc

SEQ ID NO: 264 - DNA (genomic), 545 bp, PORYPHYROMONAS GINGIVALIS; double-stranded, circular
  misc_feature 1...545
  hypothetical: NO
  anti-sense: UNKNOWN
cagaaataacttatcaaaagcaaactccttgattatcattggatatggttgtaaagataaaggaataaatgaaatgataaaggacaatttcgattacaaaaataaaccttcattcattatcgacaagtatgcaggtgcctccgttgaaacattcgctcaaaaaattaatgctaaaattattaaggaatctatagagagattagataaaacatggtttgtttaatgcaaagaggtaagagtgtgtgtcaaaatgacacacactctttaaaaataaattattgctaaatactatttcaaatattcaaggtcaatttttctatcgtgcaagtgtagcacacatttgtccacttctccatcttgaatacaaatggtcagtccgtaatcttccccattgaaatctatccaaccaaaaggcgacattgcctgaacagggatatccccttaaaacaatcttatctactgattggctgacaatttccgcattggcttgggagacatctgcacattggtttggccaaactgggtgcatgccatcccaaattatt

SEQ ID NO: 265 - DNA (genomic), 827 bp, PORYPHYROMONAS GINGIVALIS; double-stranded, circular
  misc_feature 1...827
  hypothetical: NO
  anti-sense: UNKNOWN
tcctgcgcaaagagggttatccgcgccatgcactggtttgcgaacgccatacgggttcaggattgacttcggaagacattgcagccagacagattgcacttcctccgggtatttatacccctcagagtattgaggagaaaattgtttgttatgccgataagtttttctccaagacaaaactccatcgtcagaaaaagctggaagacgtcaggcgcagtatgctctcctacggagccgatagcctccgccgtttcgacgagatgcacgccttattcaaaatcccattaggataaaagtcagaggaatatcaggagggtggcccgaataatctaaaggattctcttcctgcagaaaatctgctttttgaaatagtacagaagcctcataatcaatggatcgatgaccgacaaattaccttttgctctctattcgcggtgcgtcaaagccggcaaacgtttctactacattgatgccaaacgcgattctaaaggaaatgactatctggtgataacggaaagtaacagtgccgaagaaggttctgcaatgacgcggcataaggttttcctctatcgcgaagattttgccaaattcacagaagcctttttggacgtgctaaagtctttcgaaaagaggagcggagtatccggatgcgaacaggcgatcggtttgtctgaattggagcagagcctttccgatatgacaacgggagtggagggtttagcagagtcctccgattctattttggaggaggatgaaccgctgaaaatagatttcgatttttgatcttcctcccatttcctcctctccaaggagggactctcctcccc

SEQ ID NO: 266 - DNA (genomic), 423 bp, PORYPHYROMONAS GINGIVALIS; double-stranded, circular
  misc_feature 1...423
  hypothetical: NO
  anti-sense: UNKNOWN
gaagcattacagtactattccgtaccggcgactaacacggtcatcactactgccgatggtaaacgttatcgttttgtcgaagtcccaggctccacgccgaatccgggccaaatcggtatcagttggaaaaaaccggcaggaaacgcttacttcgcttacaagctcctcaattattggatgggaggaacaacagaccaacagagtgaatgggatgtgacgtccaattggacaggagcccaagtaccgctcacaggagaagatgtagagtttgcaacgacagaaaatttcggttctccggcggtagccgatttgcatgtcccgacaaccaaccccaaaattatcggtaaccttatcaataattcccgacaagggatttagtttgtttaccacaaggcagtcaatttggacgaatcaaccgggcgt

SEQ ID NO: 267 - DNA (genomic), 603 bp, PORYPHYROMONAS GINGIVALIS; double-stranded, circular
  misc_feature 1...603
  hypothetical: NO
  anti-sense: UNKNOWN
tgctttatgttgaatttgggcaatttgtgttaaagcgtatatatcgaatgcctcgacttctttaaaaagaatggcaggaaaatcccctgaaaaataaaccttatctgcaccaatttttcccaactcctggtattcaggattagaggtcgttattcctgaacatctcactaaatgctcatagcctaatttcttatagaaaaaatttgtactcatctatttgacactacatcagaaagctcaagggagcacatcctatatccggcaaagatacgaaaaagagattatatcacaatgtctaatgtggatttatttcaggattgaagttgtatttttctgttatgtaatttagagtaaacacaaatgctgagcattatgtaatacagagatgagaaagacgattgttaaacaaataagggtgtttcggaagtgcttgctgagcagagaggacatacagcagaaagtcctgcatgattgcagattgataatagatggaggaatatatagcacgttacccgatgaagaaaatcaacccgtgcattcgatatctatcatgaaaagcggataggcgagattggtacagtctttttggtcggtgagcctgga

SEQ ID NO: 268 - DNA (genomic), 430 bp, PORYPHYROMONAS GINGIVALIS; double-stranded, circular
  misc_feature 1...430
  hypothetical: NO
  anti-sense: UNKNOWN
ggacgaggtgcaaattcggtggcacttttttatatctttgtcccgagacgatttgctcgaatctcagcaaacgaagtctttcaatcacttaaaaacagatagttatgacagtaaagcgcgcagtgcgaatagcacttctcacgctgataggcattcttttttcctcaccttctcttgttcgggcgcaaagtcttttcagcaccgaacatgtcttgcaactatacaacaagatactctatggagagtcggcggcggataccgtcgcagagaaaacggcaggtgagtcggcatttccttttatagacaaactcatcaatctnggccgcactttcctcggcaaaccatatcgctatcgcggtccttccccatggccgatngactgctcgggctatgtgtcttaacctntactccaaaattcgacatcaaactn

SEQ ID NO: 269 - DNA (genomic), 665 bp, PORYPHYROMONAS GINGIVALIS; double-stranded, circular
  misc_feature 1...665
  hypothetical: NO
  anti-sense: UNKNOWN
gaattctttatcgtctaaccatttccggcacaagatcaatacttcccaacatagcttatgagcaagatcagcttcaaaaacgactattctgaaggtgcgcatcctgacatactgcatgcgctgacagataccaacttcgttccacaagagggatacggctatgactcctattgcgaggaagcgcgtgcgatgatccgccgtgaatgcaataagcccgatgccgaggtccatttcgtatcgggtgggacacagaccaatctcttggcaatcagtcacctgctccgtccgcacgaagctgtcatagcagcacagtcagggcatatcaacgtacacgaaaccggtgccatcgaatccaccggacataaggtttgcacagtacctactccactcggcaaactcagtgtggagcatatccgcgaagtccttgcttttcatacggacgaacacatggtaaggccgtccatggtctatatctcccaatccacagagttgggcacactctattctcgtcatgagctgtcggatctgtccaccttttgccgtgcaaacggtctcctactctaccttgacggtgcccgtatcggttcggcgatcatggnagagacagaggacaatccgaccctgaccgatatagccaccctgaccgatgcgttctacatcggcgg

SEQ ID NO: 270 - DNA (genomic), 561 bp, PORYPHYROMONAS GINGIVALIS; double-stranded, circular
  misc_feature 1...561
  hypothetical: NO
  anti-sense: UNKNOWN
agcaaaggacaaattgaaagaaagccatcgacaagtaatggcattgatcgagacattttcgaacgatgaattatttgccaagggagtattcgactggacggatacttcgactctcggtgcatactgcgtatcagccacttccagtcattacgactgggcgatgaagaaaataaagctacatatcaagaccggtaagtgaacggatgcgaagttgtttgtgtgccaaatgctctttcttcttgcagtattttattatgggcaaagtggcagtacagatctctcctaaagagggtatttttcgctcttgtaacaggggcttctcacaggtgaagacaatggagcttccggaatcatggttgaaaaaacgtatgaaggatagggaactcaccgcagaaaatcagaccgttcgtaccttgagtgaaaaacgtgagcaaaacggatgtaagcccggtagaaatcgtcagcccgactgacacaatcgccaagtatgggaagttgcctcgttggtaagtatcatttccgcatctatcggctatctcgtatcgatggaagagctgaacc

SEQ ID NO: 271 - DNA (genomic), 5118 bp, PORYPHYROMONAS GINGIVALIS; double-stranded, circular
  misc_feature 1...5118
  hypothetical: NO
  anti-sense: UNKNOWN
cgctatcgataagctccaagaaaaagaaatctcctacaccaattgcagacatcgaaagtgcggtatcgcttatcagtgagttttccgcccccacnttttgcatccttcaagcatacgaaatgcctgtggcatagcttcgcgcggtacactgatcgaagcttggcaggctgctcttgccggtgatcccggatcggcttttggcggcatattggtgacaaatactcctatcgatagggagacagctcaggagatcgacaagattttcttcgaggtgatcattgctcccgactacgataatgctgccatggaatatctgacacgcaagacgaacaggattatacttctacagaaagagcctgtacgtgagcagtggcagttccgctccatgtttggcggtgtgctcatgcagcaggtggatggtgtgacagccaagactgtcgatttcaagcctgtaacacccgtagtgcctacagcagatgaaacggacgacctcatctttgccaataaggtagtgaagcatagcaagagtaatgctattactttggtcaaggatagccaactttgtgccagtggagttgggcagacctccagagtcgatgctttgcgacaggctatcgataaagcacggaatttcggctttgacctgaatggggctgtcatggccagcgatgctttctttccttttgccgattgtgtggagatagcagccgaagcaggtattcgcgctatcattcagcccggaggttccattaaggacaatctgagcatcgaagaggccacaaaaaaaggtattgccatggtgatgacgggtgtaagacatttcaaacattaacaaaaacatagaaaataggcctgtcgcaagagaatggtcggggtatagcactcccgtaccgtcacaagcacaggaaatgcttttctacagatacagaacaagatgggattattttcttttcgacaggaattggccattgacttaggtacggctaatacgataatcatcaaagatggtaaggtcgtcttggacgaaccttccgtagtagcattcgatcgccgcacggatgaagtgatagcagtagggacagatgctcgtgagatgtatgagaaaggacaccagcatatcaggacagtacgccccttgcgagatggtgtgatagccgacttcaaagctgccgagcagatgataagcggtatgatccgtatgatcggtaagaagcatcgctggatccatccatcgctccgcatggtgatcggtataccttcgggtagtacggaagtcgagatgcgtgccgtgcgcgactccagcgagcatgcaggtgggcgtgacgtatatatgatatatgaacctatggctgctgctgtgggtatcggcatcgatgtattggctccggagggaaatatgattgtggatataggtggaggtacaacggagatcgccgtcatttcactgggcggtatcgtcatggaccagtccattcgtgtagccggtgatgaactgaccaatgatattatggactatatgcgccgcgaacacaatgtaaagatcggggagcgtacagctgagcagatcaaaatcaatgtaggtgcagcttcggaagacttggcttcaccgcccgagacctatctggtctgcggtgcagaccagatggatacccttccgaggaagatacccgtaagttataaggaggtggcacattgtctggagaagtccatcgtgaagatcgaagctgccatcctcaaagcattggaggaaacccctcccgaactttatgccgacatcgtaaggaacggtgtattcctgaccggaggaggagctatgttgcgcggtttggacaagcgtctgaccgatcgtttcggtatcactttccaagtagccgatgagcctctgttggctgtagccaagggcacggggattgcgcttaaatacgtggacacattcaacttcctgatccgatagagatagtccgaaaaaccttcttccagcatgctctaacatgcgtaagctcattgagtttatagtacgtcatcaacattggctactgtttctttttctggagacggtagcctttgtcgtactcttcaacgatagcatctaccatcgagcgcagggaatggcggtagccaatgccctgacggggcgcatcaatagcctgacgggcgaagtgcgcagttatatgagtctgcgtgagaaaaatcgtatgcttctcgatgccaatgcacggttggagttggagtacatttcgctcaagagagctgttgatgcagccgtagccgattctgtacgccccctactgttccggccggattccctcaatccgcaaccggtggagatggactacctgagagcacaggtggtcaatgcctcctataacagggtggagaatttcatgaccatagataagggacgagccgatggtgtactgccggaaatgggtgtagtgtcggctacgggtgtggtgggtgccgtaacggctgcttcagatcattatgctattgtgatcccgatcatcaacccgaaattcaaactcagttgccgactcaagggaagcgaatatgtaggttccattctgtgggagaagcccgggagcaatgtagcccagctgaccgatctgccccgtcacgtgcagttagcacagggagatacggtagtaacgagcgggtattcatccatcttccctgctaacctgatggtcggacgtgtgggcaagataaagggcaaggatacgcctttggccgagagaaattcgttcagtgccgtacctgtaatcctgtctgccgacttcggtaggctgacggatgtgtatgtgatcctgaacaagatcgatatagagaggcaaaagctggaggaggaaaacggcatacccaaaacggaggcttactgatgattcgtgagataaggtttttcttggcagctgtgctgctggttctgctacaggtatgggtgttcaactacatatttctgttcaaagtagccactcctttcgtctatatatatactctgatgctgttgccgctgaacgtgtctgtttccgctctcttgtggcgagcattcataataggcatgttcctcgatgtccttagtggagtacccgggctgcatgccgcatcattgacggctacggctttcgtccgcaacgggctggcacgtcctttcttggaaaaggattcggacttggggtattcaccgtcggcacggaatctgaaagtcggtatatatgtattcgtgctggagcttaccatcatacatcatctgctccttttcattctggactcgtggagcctgtcgagtgtgccgtatatgctgcttcgtacaggagcaagcatcctgctgacttatctgctattgcttattatgaactcgcttttcggcaagagactcaaaatgccagaaaatgagtaaacagcggaaagatcccaacgaaaaacatcgtttcctattggtgatagccactatctgtgtggtattcatctatgcgatacgccttttctatttgcaaatcctaagtccgaactataaggctcgtgccgatagcaatgctttctatcagaagcctgtatatccttcgcgtggcgtgatatacgaccgcaacggagagctcctcgtgtataacgaaccggcctatgaccttgtagccgtgacgaaagaggtaggcgaattcgacacccttgccctgtgtcagaccttgaatgtggagccggagtatgtacgcaagcgttttcaggacataagggatcgtcgtatcaaccccggctattcgccttacgtacctcaactcctgctggcgcaattgaaccctcgcgaagcgggacgttttcaggagcagctgttcaaattcccgggcttttccattcgtccccgtgccatccgtcaatataagtatcatggagccgcacatgtgctgggctatctttccgaagcgaatatgcgtgacttagagcgcgacagctcgctcattgccggcgactatgtgggtagaagcggtatagagcgtcagtacgagaaaacgctccgaggcgaaaaagggatagaagtcctgcttcgtgacgctcgcggtcgtatcaaaggacactactccgatggcaaatacgattcgccggccattcccggacgcgatctgaccctttcgatcgacagcaagctacagacactgggcgaacagctgatgcagggaaagcgcggagctatagtaatgatcgaaccggagacgggggaagtgctctgtctcgtctcttcaccctcctacgatccctcgctacttgccggtaaggacagggggaaaaatcatctggagatggaacatgatcgaaacaagcccctgtatgcccgtgccattcaggccacctatcctcccggctccactttcaagccggcacaaggggctatctttctgcaggaaggggtgatcaggcctacggatgcttttagctgttatcacggtttccctcccctgaacaacagaccggcctgtcacagccacggctctccactcagtctggtgccggcattggccaccagctgcaatgccttcttctgctgggggctccgtgccatgctggataacaggcggttctatccttccgttcaggaggcattcgagcattggaaaaaaacaagagccgcacacgggggcgccgacacacgcggacacgagatccccccggagagacgagacgatatacccaaaacaaaaaggtacaacaaaacgcataaaaggcgagagaaaacccccacaacaatatccacatcgagagcgcacagcgaaaaatcagacccactccgctccaaatagccaatctgggtgtcatcattgccaacaggggacgctatcgccgtccgcatgtggtgaaagccattcaggggatccccctcgatacagcttatacgaactggcagaatagcggcatcagtccggcgaatatggagtatatagtagaaggaatggcgagagccgtaacgggcggaacctgtcatgcagccaacttcgccccgggggaaatagaggtatgccggcaagacgggtaccggccgagaatcctcacggtaaagaccattcggctttccttggctttgcccctgcaacaatccgaaggtggtcgtatccgctatgtggagaacggcgg

SEQ ID NO: 272 - DNA (genomic), 2397 bp, PORYPHYROMONAS GINGIVALIS; double-stranded, circular
  misc_feature 1...2397
  hypothetical: NO
  anti-sense: UNKNOWN
aaatgaaccaaattcccatggtaaattttagatccggcttgtggttctggaattttcttagtcgaaagttataaaagacttattagganatggaaaaataaaatccagagaaggtcataaccttcaaagaacttaatgatatacttggtaaaaaacatctttggaatcgaaatagatccattagctattaaagtaacagctttcagcctatatttggcattagttgagcatcttaaccccaagaaactctggatagacaaaaccaataaattcccttatttgatagataatcctaacgatatttcaattaaagaaaaaaaaggaaaaaatctgtggtgtcgggatactattggggaagtgaatcctgatgattttgaaaaggtgaatttggttattgggaacccaccttttgggactaagaaattgtcaaaatcgataatggactattgtgtcaaatataattttggcaaagagatggttttaccatttctacataaatccattgagttttgtcctgatggagaaattgctttaatttttaatacaaaagtgcttaccaacacaaaaaaaacttaccagaattttaggcactggctattaaatgagaactatgtagaaaaactctataatttatctatatttaggaaatcgccgagaaactttggaggacaactatttacttctgcaataggtccaatatgcattatctattttcaagcaaaaacaccacctaaggcgtctaatacaattgagtattgggctcctaagacctacgttaaatccaacttaattgatggggtattagttgattctacagatatcaaatttctcccacgaacggagtgccaaattccaaacagtaaaatatggaaaatagccatgtggggcaatattgcagattataatctaataaaacgcctatccaacacctatccttctttacaaaggagttttaaagataaagttgtctatggtgttggattagaaacaagtgttccttgcaaaaaaacagatgaaaatatcaaattaattcctcatcacacatcaaaaacaatcaaacgtttttatacacctattaactttggtactagaataacaaattcctttttcagaagattaggatatgttgatgcatatagggctcctcacctattattgaatgagggagtccagaaaaataaactcacggcttcttttttggattacgattgttcttattttaagggaatcgtaggtattatttccgaaaaatctgatgaaaatattttgaaactaacttgcgcatttttaaattcatcatttgctcaatattatgcttttatgacaacttcttcatggggtattgagagagatgttgttaaacatcaagaattattcaccattcctttcatcatagaaaacttcaccgagcaaaaaaagcaaacaattatttcattattggatagtgttattaagaagcaatcccaaatatcttttggggattatttggagcttgaagataatattaataccattcttctcgatgatttaacagaaaaagatagaattattataacggactctcttcgacagatagacctcttccaaaaagggagtaaatcaaagttgctaaggcacacaactaataatgaaaatttggcctatgccgagattttaaaacaagagctgaatgatttttattccggcactggccatggaattaatatagctgtatatgatgtgcagcgacatgaccctttaaacttggtgacattgcatttctgcaaaaaagaaaaacctattgaaataaagcagacgaatgaactatcttccttgcttaaagaattagacaagtattctattcaagaaaaaggtaaaaatatatatgtacaaaaacaattcagatattacgatagggataaaatatatttgattaagccaaatcagaagcgtttttggacacgttcacaggctattgatgatgccctctcgctcatcgttgaaattgcaaatttgggaacaaaatgagcggaagatttaacccagagtatatagattgcacattgcagatattggagaggcgttgtttgactttattgtgcgatggttattgtgtcgttaaatctaaaggaagtatttctattgacaaggaagaggaagatatatcgaaagaactactactatctataaatgcgaatataaaaaggatggaatggcaaatagatattattcctgaatacaggctctataaaaatgatggcattgctgctaaaagtgcagcaagaattgatttccgtttctctggttggagtacaaatcagtgggagtattttgctgaagccaaaaatttaattgaaattgattctttcaaagctggacgaaaaacaaaaatttcggcagggccgagctcaagaggat

SEQ ID NO: 273 - DNA (genomic), 410 bp, PORYPHYROMONAS GINGIVALIS; double-stranded, circular
  misc_feature 1...410
  hypothetical: NO
  anti-sense: UNKNOWN
tggatttggcacgtctatgcggcatgcaaccggctgcagccctcatagagattatcaatgaggacggtaccatggcacgtttgccacagctatgggaggtctccaagcgttttggactgaagatcattgccatcaaagatctgatagcctaccgcctcaaacaagaatccatcgtagaaaagggtgtagaagtggatatgcctaccgaatacggacacttccgactcatacctttccgtcaaaaatccaatggactggagcacatagctttgttcaaggggacgtgggacgaaaatgaaccgatactcgttcgtatgcactcatcctgtgccactggcgacatattcggatctatgcgttgtgactgtggcggccaattactgcaagcaatggagaagatcgagaaagaa

SEQ ID NO: 274 - DNA (genomic), 540 bp, PORYPHYROMONAS GINGIVALIS; double-stranded, circular
  misc_feature 1...540
  hypothetical: NO
  anti-sense: UNKNOWN
gcgtgataaggctgcggtaatactcgtgtgtggagaggtgcttggcgagagaccctcttacacctcttttcagcccgtacttctccatgtgttcggcgtaggtgtcctgatacctgataaggctggcacggctcatcacctcgtccgcacagaggcgtggggcaggtgctttcgtcctgtacctgcgccttgcgttctcttccttcttctgcttcctgcgctcgccctgcactatcggcactacggtggcatggatgtgcggcgtttcctcgtccatgtgcagcactgccgatacgaggttttcagctccgtaggtctctctcagccacgccacgctgtcatcgcaccactctccgagcctcccttcgtcttccatccgtgccatatcctcgtgcgttccgctcagcacgatgccgtattgcctgcacttggttctttccaatcttacgtttcaatcccgccgtgtcaaggcggtggcgtatggctaacgtgcggttgcacacgccgtcgggaaacattattaactcacggtttagatgc

SEQ ID NO: 275 - DNA (genomic), 2354 bp, PORYPHYROMONAS GINGIVALIS; double-stranded, circular
  misc_feature 1...2354
  hypothetical: NO
  anti-sense: UNKNOWN
ttatactccgtcggatcgggatgattcagtagatattgcagatcggcacgcgctcggctaccagcggcacgaggataaaagccaaagtcggagtgcggagtttgcccgatcgtccggcctcggaagcggcatcgatgaagaggtcgatacctttgttcctgtactcgtaccgtccgctcgtggctatcagtaaggtatcggcaggcagttgcttgccggtcagatgttccgctacgtggagcagtcgctttcgcgcttctgcacgtcgcctctcgtattcttctccttgtggcacgaagttcggttcgaatccgttgggcagtaccatcggatcgcgttcgagcagttgccggcattctttggccgtgagttcgcttaccgtggcaaaggtgtccgattggtgagccgccgctttttctatcccgtgtttggcttctacaccgagttcggcagccatttgatcgccgttgtagcccggcatgtaggcatacagagctttgttattgccggcgatagaccgccctgtggtggtggcatgtgtgaggaaaagggttttcagacgaggtgttttccgcttgctgtagaggagtcccatgccgagcatccattcgttgaatatacctatggccggttggtcttcggggcagaggtattcacacaggctatgcatcgtttgggctgcggcaatgccgaagagcgaggcctcgtcatagtcgccgtaccccttgtcgctttggatgccgaagtgctcccacatctcatagtagagcgttgctttctgtgcatggaggggttcgaagtccaccagtactacagggggagaaccgggagttcgccagctgccgcacacatatcgcaagtccagcgagggtgctgcatcacgatgccagtcctccaagatggcagggactgtattctcaaaatcggtgggtaagtcttcctgctccgttagcagggggcctatgaaaatgatacgtccgtcgtggcgtttcatcatctcatgtgccctcgatgtaagcacagtgtatataccaccctgcttattgcaaacctcccagctcgtctccagcaagagggaagggttggggcgaaaatcattcattcgatcgcaattcgtttgggaaagttttttccggtcttatcctccgaccaaccgccatacaaaggccacggctacggtcacaacgaaacctgtggcaagcggaatcaaggctgccagcagcgtccatttccggctccccgtctctttatatatgttaaacagggtggtgctgcaaggattgtggagtaggcagaacagcatgagattgatacctgtcagcatagtccaaccgccggcttcgaacagtcgtgccgtttcggctgtgccatcggcttcgaacatgacgccggcaccggttcctccatctattcccgtagtcaggacagtcagcatcagtatcgtcggtatcactatttcattggccggaatggccaatacataggccagcagaatgacaccgttgagtcccatcagccaaccgggtccgtccagcaggtcgatcagatattcggctatcccgactccaccgatttggatgttgcaggtgagccagataagggcaccggccggcgcggcaaagacaacggcacgccacaaaacgacgagtgtacggtctacgatggatttatagatcgtctgccaaaactgtggcgggcggtagggtggaagctccagattgaacgtggagacttgacctcgcagcagcgtccgggagagtacccaagagaagaaaaacatgaaagcgatacccagcaatgcaatggccacgactgacccaatgccgatcacgccacgcaaataggccggtacggcaggtgtgaggaagatcgtggcaaggagtatctgtgtaggccaacgcccgttacacagagagaagttgttggtcagaatagctatcagtctctccctttggctatcgatgatgcgcgtattgatgattgctgccgcattgcagccgaagcccatcgtcatggtcagagcctgcttgccgtgcgcacccgaacgacgaaaaagttcgtccaaattgaatgccactcgcggaagaaaaccgaagtcttccaataatgtaaatagaggaaagaaaatggccatcggaggcaacatcacgcttacgacccaagccgtagccaagtagacgccatcgatgaggaatccgctcaaccaatccggcaggaaacccgtagcccgtgttttcagcaaaggatggagaatacctacaaggctgtcgcttaaccactgggacggatagttggagcctacaatggtaatccatagtaccaaggccaacatgagcaacatgatgggaaaaccc

SEQ ID NO: 276 - DNA (genomic), 545 bp, PORYPHYROMONAS GINGIVALIS; double-stranded, circular
  misc_feature 1...545
  hypothetical: NO
  anti-sense: UNKNOWN
ggcatttcaaaagcgataaacagcccttacaatgaataaaaaagtaccccagctgtcagtctccaccgttgtgtaccgaaaaaagttgacagttggggtgagcgggattcatataagtttacacacataccggttagtcctatgctggggttacaactgtcgattggtatttccccttaggtttacacaagcagatttagccctttgctcgggattcattcttctgtagttgtagagttccggagcaatattccgagcctctctttgttgtgtatataaagagagagatttgtgtatatacggaaatatatttccgtatataagaaaatttatcggagtatatacgaaaatatatttccgcatatgcggaaatttcgccaccttcttggtgcgataaaaacgctgacgctgaactacttggcatcggaggcgaggtattcttcgaggatacgaaggcgctccgaattgctgagatgttttgacatttttttcttggtttgtcgcacaccccaactgcaacttttttcaggncacgacaggatcaa

SEQ ID NO: 277 - DNA (genomic), 444 bp, PORYPHYROMONAS GINGIVALIS; double-stranded, circular
  misc_feature 1...444
  hypothetical: NO
  anti-sense: UNKNOWN
aggctttacgccgaaacagtgtgctttctcataggccatgacggcgatgtccacaagagcctcggccgaaaggttgtgattgatcagcgtatcggccaggaagagtggcccgttcttcaggctgaccatatgcatagtggcaaagtgaccgacgccctcttgcaggccgacagtctgcttggccacttccgccagatagctatgcttgctgtatatgcccgtgatcatagcatcggcatcccccaagcgcaccatcatcataccgaaatagttggggtcgaacatcttgtccagcgcttcggtatgattgcctccgcgccgccagttctgttcggcaaagacacgggcataatgatgaccggcgagcctttttcttcaatcggaagccggtaatttaaacgaattttcgataccccttccaaagattaaattcccaactcttgc

SEQ ID NO: 278 - DNA (genomic), 580 bp, PORYPHYROMONAS GINGIVALIS; double-stranded, circular
  misc_feature 1...580
  hypothetical: NO
  anti-sense: UNKNOWN
gtatcttttttgtcctgatataccgtagcgatcagctgatacacgtcgttctgacgatagggaacatccttgatcttgttacagatctcgagcgttctgtccaagtcattggcctgataggcacaaaccgccgagaagaaccctaccatcatagagttggaatcctgtgcagagatttcgggaacagcagcaaacatcggcagctccttgatttgcatgaactgatcgaaggcttcgagagctttcttatagtctttcttctccatgtagtaaccaccggcattgatatagtaaagatgattacccttgagagattccatgatcttctttgtgaacttgggctttaccttacccttttgatcaggcatattgtccaactggtcggccttcaaataaaacggcaaaatgcgcagcaaagcatcgttcatcatagcacgatccggctcctgattcacagtttgcttgagattctctggatgtaaagagtctctcttccacctgaccggccacaaaccaagtcttggcatcgttcatcgctcggggttcttcatggcttcaccgatccagcgtacgagctcgg

SEQ ID NO: 279 - DNA (genomic), 727 bp, PORYPHYROMONAS GINGIVALIS; double-stranded, circular
  misc_feature 1...727
  hypothetical: NO
  anti-sense: UNKNOWN
agcaaatcagatctatttgccgatggtagatttcagacctttcaaggtcggtaaatcgctgcgtgagcttacgcaggcacctgccggtgccccggaagacgtatatgaatatgtctttgtgtacgaaaagaatggcaagcgacaggagttcgatatggatcatctgcctgacgacagctggacatacgtagatcggcacgagaaactgattaaaaaaggctatacacctcccgtcactgacttccttttgcttcgtgggggtgaagatgttacatccgaaatcgtcaataaaaaggggattactctcttgctcctttcacccgattgggagaatgcaagcgacgataagatggacaatatcagtgagatgtatgattatgctcaggaacatgcttgggacttctacggcgtatcggcttccacttcggatgatatttccacatggcgatacaataccggtgctgattacccgatgcttttcctcgatgctgttaccgttaagaccattacaacgcggcaatccctctttggttattttgcgggatggtgtaatccgaggcaaggttagtgatgcgaatttccccggtgtgggacaagcccaagcttttttcgatcgttatataggcaatgagctttatcaaccttcttattggggaaggttgcttgtattggctttgtgggttattctccttttgttcggatgtattcgcaaggtcgttttttgcat

SEQ ID NO: 280 - DNA (genomic), 509 bp, PORYPHYROMONAS GINGIVALIS; double-stranded, circular
  misc_feature 1...509
  hypothetical: NO
  anti-sense: UNKNOWN
gaaccgacgaggagaaagaaccaaaaaagaatcgtttgtcttgtcttcttcataattatatcaacgttgttaggagttatacaataacatcattcgccaatgcggcagcaggcttgcagcgtatgtatccactggcaagcaacgagacctgccgtttccgttcgcaagcggctctcaccaagagaaacgggtgcaaatccggcaagcaaggcggactccacttcagacggagagaagtctccttccggccctattagaatcagtacatcctgtcctacgtggtagaaatccgacggatagcctcggccttgggttatttcggctcgaacagcttcgtccacataagcgataagacgaacagctgtcttcggagtgtcggcaattacagtttgtatggggatattgacttgaatcacgggaaaaggaggctttgagcgactgcttcatcgcactaattgcgatgcgcttccaagcgttccgcttttgataccgcctacgctcggaatggt

SEQ ID NO: 281 - DNA (genomic), 3517 bp, PORYPHYROMONAS GINGIVALIS; double-stranded, circular
  misc_feature 1...3517
  hypothetical: NO
  anti-sense: UNKNOWN
gccttccgaagagcaaatgccatgccaaacaatcccctgccctcattatcagtcacttattcgattggccgaagtgtccactgtccgttttcggacagttcgggtgttcgtttccgaacagtcggacacttcgccatcggagaaaacttgcatattatcagccttttaagggtagcggcataaactttgctgtcggaaaggtgcaataaaaacgaaagaaagatgaagaaaaaaagccttttcctcctctccctctgcttcgcctccctgggtccgactccatggagcgaggtttcggcacagcaggttgccgccgcggatccatcccctttgtccctcacggaagccatccggttggcacgaaagcagagcgtggatgcagccgtggcactgcaagagcttcgagcggcctactggcagtggcgcacctatcgggcagaattgctgcccggagtgaacttgacagccacactgccggactacaggcgtgcctattcgctctatcagcagccggacggctcttacagcttcgtccgctccaatgctctgcgcctgtcaggacatatatccgtggatcagaatatatggcttacgggtggcaagctctctttggtgagttcgctcgagcatatcaatccgctcggcacggaaggagctgacaggcatttcatgagcgtaccgatcagcctgaccctgagccaaccgctcttcggactgaacgaaatgaaatggagtcgccgcatagaacccgtgcgttacgaagaggctcgccggcgattcgtcgccaatacggaggaggtgagcgtaagctgtatagatcattacttttcggccctgctggcacgggaagagtacaacaatgcggagaccaacctccgtaacacggcgaagctggtcgaagtggcgcgtgccaaaaagaagatcgggaagttgtccgaaaacgaattgcgagccgtggagatcagctacgcttcggcttcttcggcaattctttcgagccgtacagccctgcgcggagcggagatgtccctgagcattttcctcggtttgcagccggatgaagtcctctccctctctataccggccgatacgatcttcacacccgtgagctatgaacgggtgatggagttggccggacgcaatcatccgttcgtcggagagatgaagcgcaggatgctcgaagccgatcgttctctggcccgagccaaatccgaacgcttctccatcgaactgatggcccaaatcggatatgccggacaggcggacaatctgcacgatgcatacggcggacgtctgaaggacaacagctctgtctccgtaggcgtgcgcattcctctcgtggattgggggcgcggacgcggtcggatacgcttggccgagagcaaccgccgtctcgaagagcatcgactgcgacaggaagaagagcgttggcaccggcagatattcctgctggtggagaaacacaacaaccaacttcgcatcctcgaattggcacgtcgtaccgacagtatcgctcaggcgcgctatcatactgccgtggaaaccttcaccgtcggggctatttccaccctcgatctgaatgcggcacaggatgccaaggacctggcgcgtacctcgctcgtcagagcattgcatcactattggagctactactacaatctgcgtagcctgacggctatgatccggtacgcgatgaggagatcgatatacccatggaagaactatagggacaaaggaatcggacgatcatagcaatgggaggaaaccgactgatacccgattgacctgaaaaggtatatgctggcaaaccggagaattcttctattttgcgcatgtttttgcgcgaagtcggttagaaatctttccggccgaggcaaaatgctaagtattattggacaaaaaactctaaccattatgtactggacattagaattagcctccaaattggaagatgctccttggcctgcaaccaaagatgagttgatagactatgcacaacgttcgggtgctcctcttgaagtcatcgagaatctgcaggaaatggaagatgaaggggaaatctacgaatcgatagaagatatttggccggattatccgagcaaagaggattttttcttcaacgaagaagagtactgataatgtaatctccttaagcgaatatgccccggatgtgcaataatagcactcggggcttcgttttaccaccgtggcatcagtcttgcataaatctttccgttcgctcattttgctcctgctcctgaccgtggccgggggagaggatattttcgctcagggcgatttattgctggctcagtacacccgtgcatacggctactacaatccggcttatgccggtatgcgcaaagagattttcattactgcgctgcacaatagacaatgggaaggcatgccccgaagtcctaagagtttcgtcgtactggccgatgcgcctattcgcttcttcgacagagagcatggagtgggagttcgggtagtgaccgaaacgagaggactctttgccatcaatgagctgatggggcaatatgccttcaaacagaaactcttcggcggagatctgtccgtcgccctccaagccggactcgtcaatacggctttcgatggcaccaaggtggagctcgagacggagaacgatccggccatcccccttaccaaagtgagcggaaaggccttcgacatcggtgcaggtatatactaccgccgcaaagaattgtacgtcggattcagctctacccatctgaccgctccggcaattccgctcaatgaacagtacatattagatctgacaaggcattattatctccttgccggatacaatatccgctccatttattcgttatttgcatggcatccttctatctttgcagctactgacgggcacagttctcgtttggacgtgacgatgggaatgtcatacaacaaccgcttctttgcctcactgatgtatcgtcccacacaagccgtgggagtgagcttggggatgcagttgggcaagttctatgccggctatgctttcgagtggccgacatcggtactggctaaagcctcatggggaagccacgaattgctggtcagctattctttcccattgagcaatacgaagaatagagatgcaaagtataaaagcattcgtttcctctgaaaactgccttagcgcaggattcggggagagcagcgaagcagatatataaataatgtatgtgtagaaagaacaggtttttcgctcttgcaggcttttttctgtttggagttttcactatttcgtcgtgcggctcttccaaacgggctgttggcggtgaactgacccggtgccaagctatcttcatggaatgagccatcgcctttcgggatgatacaggttccccgagggaagtattggtggttgggcaaccaaagaagcagacagcttatggggcataccttgccgaatcgcgccctatatctggtggatgcctttttggatggatcggaccggagatcaccaatgcccaataccggc

SEQ ID NO: 282 - DNA (genomic), 4606 bp, PORYPHYROMONAS GINGIVALIS; double-stranded, circular
  misc_feature 1...4606
  hypothetical: NO
  anti-sense: UNKNOWN
aagctggtcttntgcagatcggcactgctctnagatatgtgcctacatcggtagagatatcggtgatattatcctttcttaaacgttcgatctccgtatctaccgtgccgagctcgccgccgatcatggccaaacgttcatcgatgaaagcagccgtactgacagcgacactcttcttgtcgttcatgacatcgtcgttatacgaagcgataagggcatcgatgaaattcttcgcacgatccaagtcttcgtttttcaatgacaaattgactatcgtagccttcttgtctgccaatgacacctgcagatcctgattgtaacgctctaccactttacgagtattctctttcgtcacatatagcacttctcccttccatgaatcggcaaagaagagtgtcgtattcagttttagttccccgacaggagttgcaataggccgaccaaaagagccgtctattttgatatcgcctatcccattacgctctttctgctcgaaatgggtcagctgaaaagaatgtgcatcattgatctgaatcctaaaggaatagttctccgtagaatccctgtcagtaatctgaatacttacggggctattgccatacaacgattcattgcgccaaaaaccttgtttgtatatggatacatccagatcaagtttgtcgactacaatagcagtcaaacgcttggatttgagcattagaatctcgttctctacttccgaattgcctatcatcaggccgagttcctggaactgctgcaggccacttgtcgcaccgcttttctctgcacttttgatcagcacggtagcctgtgcatgatagatcggggactggcgttggatataaatataggcgatgagcaaacaggccaatacactcgctacaatccatttccatgatgtcaggagactaagaaaaaattcttctaaggagaagaatgcggtatcttccgtatcggaaatataggatctaccctgccgggtaaacgtgtttttggagtcttcgttcaaattcattctgtgattcttgacgcttatagtttatttggtcttatctattatcgtaatcgtcagcgtggaaatggataccaaagtggaggtaacactcagccatacgtttacgttattattctggttgatctcgctcatctgtgttttcttgtcgttcggctccacatagatgacgtcgttctgatgcagatagtacacggggcttgcgagcaagtcggcctttctgagatccgtctggaaaacctcgcgatgcccatcggtttctctaatcacaaaaacccgatcgcggcgaccatagattgtcaggtctccggccattccgatcgcttccaaaagagttattcgctctccttttaccgacatcgaacccggatgattcacctctcccaaaaccgacaccttgaaattttgaagctgcaccgttaccgtaggatccttgataaatccactggaaataatcctcttctgtatctccttctccagttcggtacgagtaaggccctctacatagatctggcctaaaataggataattgatgtaccctttcgaatcgaccaggaagccttcgttcgagttcgttccatagccgttgcgggccagtgcacgagtggtcaacacttggttgtagggcgttgaaagctccgggtctctactgctgacaaggatgttcagcacatcgtccttctcaatttttacgtcatatggtttagcgataatctcccgattaaaagtttggatatcttgcaggtaaacgaccttttctcgctgggaacggcatgatgcaaaaagcaaaaccgaaaaagagacgaacaaaaaattactgacaatacgcataattgatttatggcttaaaaaagggggttgttgatgtacattccgtactatgggcgcaaagataatcacaatcccaattttgccgacctctaaaacgctttgagaatgatatttattcatgacgttttggaagcttcttcgatcaggagaggattgcggtcaggcgtgttgcgaggttgtgtttgacgggcggaaaatgccgagtggtttttgttaactttgttcatcctcaatcattaacagcttcgcttatgaaaaagatattatcgacggtgatcctcatttgtattttatcctctttcggtgtggcgcaagtgggagtgccacgaatcgatgatatgagaggaatgcgtatggacaccgtgtctaagaaaataaaggattatgcacaacggcggttcttttataaggtggtttttgtggaagataccctgaagcgagaaaagaaaaccgaggcgcagtgtgtgttggagatcggacggcacggcagcagcttcaaggatttgtatcagttagcctgggattctttgaacgatgccgttacccggcgaaaaggttcgatgatggagctattcactgagggtgccgggttggtgaaaaagataaagtggagaatagtcctgctgaaagggtatcctgaaggagcggaccggcatcaacaagaggtgccattgacaggtcggtatgagtatgaatgtccgtcgccgtctttcgattggcagatcggggaagagaccgaagagatcatggaatacacttgccgaaaggccacctgccaccacagcggacgggattatacggcttggtatacccgaggatattgccctctcggatgggcncgtacatttttcggggattgcccggcctgattgtggccatcgcttcggatgatggggaatatgcattcgaacttaatggaatgcagggggagattactttcccctcacctatatttctgtacgacaaaaaggtgcaaaagtattcgcgcgaagaagtacgcaagattatccgaaacatttcggagaattattccgagaccatcatcaatcagggaagattcaggcttaagaatccggaggatattcagcgtatcagaaatttgccgtacaatcccttggagaaagaatgaaaacaaataaaacactcagcatgaaaaggacacttttgttcctcgcatcctgcttttttatgagtatgagcttcatacaggcacaggtgccacgtatcgtgggcgcagaagggatgccggtagatactgtgcccaagagggtggaggactataccaaacggcgatttttttacaaagtctcttttgtgaaagataccacgaggcgagacaaagaaacccaagcacagtgtgtattggaaatagggcagcgagggagttgcttcaaagacttttacgagtatgcagcggactcggtgaatgatgccgtagctcggaagaaagggactgctatggagatcttttcgaaagcttatgattacgtcaagaagacccaatggcggactcccgtacttaaaggctatccatcgggacaagattatcatcaatacggagatccgatagtcggttcttatgaatacggttgtccgtcgccgtctttcgattggcagatcggggaagagaccaaggagatcatggaatacacttgccgaaaggccacctgccaccacagcggacgggattatactgcttggtatgccgaggatattgccctctcggatgggccgtacatttttcggggattgcccggcctgatcgtcgctatcggttcggatgacggagagtacgtattcgaattgaacggaatgcaggagattacatttccgtctccgatttatctcaagaaaaatgcctttacgaaagtcggctcgcgtgaagagatgcgcaaaacgattcgtaatatccacgagcattatgccgaagtcgtggccaattcgccggcttttgtcaattccccgataccggtagacttttctcatctgccacctcagccgtttaatccattggaggaggaataaagcatgatgaatagggctgtcacttcgattttggcgtatttgtggctgtgcgtggcggggctgttgcctgtcgttgctcaggaagcgaccggacaaatgcttgccggtcgtgtgatagatgccgagagccaggagcctcttgccggggcagtgtgccaactcatggatgcctccggcaaaccgcttgccttcgtcctctcgaaagccgacggctcgttctctctggagaaaaaagccggcggaaaactccttagcgtaagatatatggggtataggaagatgagcaaagccatcgatgcggctgctcctccgctgcttttcgctttggtgccgtccgacgtcaagctcaaggaagtggtggtacgcgccgaaccggtacgcaagctgggagatacgattgcctattcggctgcggctttcgtggggccggacgatcggtatctggccgatctgctgcgcaaattgccgggaatagaggtctcggcaaacggcctcgtcaaatatcagggcgaacctatcacacatatgtatatcgaaggcgtagacatgctgcaaaaccgctacaatctggcctcccggaacatgcctcaagaggcggtgaaaacagtggaggtgttggaggggcatcagcacatcaaaacgctgcgggagacagtgccggagaaaagggctgcactcaatatcaaactcaaagaacgcttcaaggtgcgtcccttcngagaagtaacggccggcgga

SEQ ID NO: 283 - DNA (genomic), 899 bp, PORYPHYROMONAS GINGIVALIS; double-stranded, circular
  misc_feature 1...899
  hypothetical: NO
  anti-sense: UNKNOWN
ttacagctcatggtacattcggtagtgcattcagtgctcccgatgctttccaaaaagcaggccaatacgtaggcccgttcgggcacggaccataggcaatcctgacctgaaacccgaaaagtccatgacctgggacttcggtatcggatacagcaatgcacgctgcgggatccaagccgacgtaaccttaacctatttccacaccgaccacaaagatctgatcttgtccagccctgactatgctaataatatcaccacatacatcaatgccgacaaggctcgtatgagcggtatcgaggcccttttgtcttatgacttcggcagcctctttgccaacaagttctctctccgcgcatttgcgaatgccacgatcatgctcaattccgagatgaagaaaagccagaccgatgccccttggagcgaaatgtactacgttcgcaagcagaacatcaccttcggtatcgaatatcgtggcaaagaaggacttgaagtgatgctcaacggtcgcttcatgggacgcaggatcgagcaaaactggtatgcttactaccccgaagttcgccccgaactccagcaactgcttgcagcagaagagcctgaattggctgctcagggactgctccgtcatccgcaagcaatggtgttcaatgcctctgcttactaccacatgaacaagtatctcaccttcggtgtgaacttgaacaacatcttggatgagctttatacggagaaagacggctaccacatgcccggacgtaacatcatgggtaaggttatggtcaacttctaattctctttcccgagagcagatataaaagggagccggtctccctgcataatcctcacagagcaaagcggatattcctctcataccgagaagcgggtatccgctttctgat

SEQ ID NO: 284 - DNA (genomic), 460 bp, PORYPHYROMONAS GINGIVALIS; double-stranded, circular
  misc_feature 1...460
  hypothetical: NO
  anti-sense: UNKNOWN
ttcttcttctttttttattgccgctgttgctgggatggttggcagactactttttaggagatcctctttctcttccgcatcctatagtcggcttcggtcgcatgattgcattcggagagaaaagattgaataaaggaaactaccgcaaggtgaaaggcgccttcatgtcggtgttctatatcgttgccgtttttcttttgaccctattgatcctcttgggacttgtttttgtctgtgtttataccattttgctggacgattttttccggattgctgttgcatttgctgtggcttctcttattttggctatcggcattttcttctgtttggcaggtactacccttattcgtgaaagtacgtatggtatttcgaaagcaagtccgaatcgttccgctttgaaagaaagggccgccaaaccagggttgaccgccgaaatcggtaagggccgccgaataccggg

SEQ ID NO: 285 - DNA (genomic), 530 bp, PORYPHYROMONAS GINGIVALIS; double-stranded, circular
  misc_feature 1...530
  hypothetical: NO
  anti-sense: UNKNOWN
gaaattgtcatagacagggcctcccctcgggataatcacagggtggctgccatagttccaacaaataagttctgccgtatggagatcgaatacgagctgcaccctgtcgttagcgatatgaagatgattcccttccgtcgttacttgcagcgtgggcatccgctcaggcaggagggaagcaaaaccctctctttgtgcaagtgtaaactgttcggatgctaccgtgtatcccttatcggaccaagtggtggcttcacgaaggaagagttcgaaatcgatatggaagtcgcgagtcgaatacattggaatatcggcgacgggtatcctcaatgtagctttttctcctgccggcaatttgggcagatccacttctccgctttcgatcacacagccgtcggagaggagcttaaaacgaagaccgaatcgattcaaatccgtaaaggagtaggcattgtgcagagtgagcaagtttgcttttactgtccgtatgcatcgaatttcacgtactggatacacttttcttcacttcg

SEQ ID NO: 286 - DNA (genomic), 399 bp, PORYPHYROMONAS GINGIVALIS; double-stranded, circular
  misc_feature 1...399
  hypothetical: NO
  anti-sense: UNKNOWN
agtgttgtgttatgggaagggtgttgttttatttatcatcggaatcgnaaacagactattcggctacttggatttctcttttttatccctgatgccatattttaccctttttaggccgaatatccccttcaaggctattgaggtagtgagagtcatcgaaaatttttagaagccttctgagctatgttttttaagccacttaatttactgataccgccattttgtcagtttagaggatccatctttatcgcgttacatttgtgattgccaaatgaatgtaaaattacacttcacaacaccactttcgatttacattcttaatccgatcagggtgtaatcatatttaatccgaattgaatccacatatgtaatcatgtcaatttnacgcctgaaaacgat

SEQ ID NO: 287 - DNA (genomic), 3357 bp, PORYPHYROMONAS GINGIVALIS; double-stranded, circular
  misc_feature 1...3357
  hypothetical: NO
  anti-sense: UNKNOWN
acggctccgataccggcttcatgcagacgggcatattcttccgtggtcaggggctgaacttcgagcgagagttgggagaagagtggacgcagtcgccgcgtcattttctcatagtagcttgccggagtggctttctcggactctcccgacacgagaaggaggtgtttgtatccgagccgaaggatcgcttccgcttcccgatccacctcttcggcagtgagtcggcggcgatggattttgttcgaccgactgaatccgcagtatacacaggcattgctacagatattcgacaggtagagggggatatagagctgcatcgtgtggccgaatcgctctaccgtcagggcatgcgcctgccgggccatctgctccagataagggatggctgcaggcgaaataagcgtgataaagtcttggatggtgcggcgtcggtatgccaacgaacgctccacatcggcagccgtagcatcggccaagaggttacccactcgctcccaagtatagggggaggcgtgcaagtgatcatagaaagtcatattccggaagaattatttcagattgaggaaagaggtaaacggcgagctggcttcggcttcggagcggacgctgccgaacttggcttcgaaagccattcggccggcttccacggcaaggcggaaagccgtcgccatgcttacgggatcttccgccacggctatggccgtattcaccagaacggcatcagcccccatctccatggcttctgccgcttggctgggcgcaccgatacctgcatcaatgacgaccggcacacgactctgttcgatgatgatacggatcatttcacgggtcttcagtccgcgattgctgccgatgggagcacccagtggcatcaccgtggctgcgccggcttcttccagatgcttgcacagcacaggatcggcctgaacgtaagggagcacgataaagccacgacgaaccaactcctccgtggcacgaagcgtctcgatagggtcggggagcaaatagcggggatccggatgtacttccaacttgagccagttggtttggagggcttcccgtgcaagctcggccgccagaatggcttctttggcagagcggacacccgaagtattgggcaggagagtgatttccggatggcgggtgatgcgactgatcatgtcgtcttcttcgacgcgaccgatttccactcgtttcagggcaacggtcaccatacgagattgcgatgccaagaccgcagcctccatcaggtcggaggaagcaaacttacctgtgccgacgaataggcgcgattcaaatgttttgccggcaatttgtaacgtttccattagattttttcctgtttatcaaaagatgatcgttcgatacggaagggagatcatccgattagttcttttttattttcctgataaggctgccgctcacggcaatacctcctatgccacagtcgcgaatgaggggaatgtctgcatcctctatcccaccgatggcaaaggccggcagtcggatgccttcggcttgcatacaggcggcgatggctttgtagccttcgagtccgaggacgggagctaaacgctgcttcgtctccgtatagcgatacgggcctatacccacgtagtcggctccttcggcatatgctcggcgcacatcctccatcgtattgcatgtgcgtcctatgatcttattcgaaccgaggatgcgacgcgcttcgactatcgccatatcctctttgcccaagtgtacgccgtcagcatccacctgacgggctatttcgacacggtcattgacgacaaaaagtgctccgtggtgacggcagacagccttgacggcacaagccgtgtgaagcatctcttcgtccgaagcctccttcatccgaagctgtacccagcgcacacctatacggcagacggcctccgcttcttcgagttcggacaggtcgggctgacggtgcgtgatgaactgcaaatctatttcgctcatcagcctgacgaccggatcgaccggcaggtctttgtgcatagcgagcaaccccgaagcacgctcacgtagtcgactgacatataactgtgccatcccggcagccgtaaaaggttcttgctccaaggccaaagcagctgcaaaagcggtgctgtgggcacaacccgtgccatgcttccccgtaccgccgcgtaagagtcggagagcttcgcatcgaccgtcgtaaacgatccgatccgttacgaccgattctccggcatgcccccccttgaggacgaggccgacaccgctccttcgatagaagtctaacagggtctcatcgtccggttcgcagcccaaaaggtggcgagcttcgggaagattcggcgtgatgaagtctatccgggacaaagccgttatatcttcaagattgaaacgatccgcttgtcccgcggagctgtcggccgaagctctgagtacgggatcccatacgatccgaatcgaggggaaaacctttttcaaacaatccactacgagagagagggtgtccgagtcgcggatcaggccgatcttggcgacggcaggctccatctcggccgacaaagattcgatctgccggatgatgtccgccgaatccacccatcgctccccccgatagctgccactcccctgaaaggtaatagccgtagccacggtataagcccgcacgcccatgttttcggccgtccgcacatctgccgtaatgccggctccggccgacggatccactcctccgacacagataacagccggcgtacacaattcctgccaacgcatcagttcccggccttcgaccaaccacacatagccgagtgcagctgccgaggcaaagcctgctctacgaagctgtggcagacgatcgggcgtaatgccgcccagtgccaccacgggcagatggagtcgctgcagacgatcgcccaaagaatcgggggaaaatcgtcctgcatagcccaccttgcacagactgtcgaacacggggcttaagaaacagtagtcgagtcgaaaggggaaggactctatatcctctatcgcgtggcacgaagctgacaccgtacaaccatcagggagctgtggccgatcggtcatgcctttccagacccgttcgggcagatgcaaaccgcacagtccgtagcggccgacgagccggggatggtcgtgcaccacgattctccggcgatagcaagctgccacagcttcgataacctgcgaatagtcctcttcgccggcactgggcaaacgaagatgcagccgctccaagccccggtcgaaaaagtggtcgagcaggccgatttgctcgctcgtaagcctttcgggagtgatcagccacggtttcatttggagactgcctctttcgtttagcaa

SEQ ID NO: 288 - DNA (genomic), 669 bp, PORYPHYROMONAS GINGIVALIS; double-stranded, circular
  misc_feature 1...669
  hypothetical: NO
  anti-sense: UNKNOWN
aaggacaagcagttggaattggacaaacgctatctgcgcatggcgcgcatttgggcggagaattcctactgcgaacggcgcaaagtgggtgctcttatcgtcaaagagcagatgatcatttccgatgggtacaatggtacaccggctggttttgagaatatctgcgaagacgagaacaacgtcaccaagccctatgtcttgcatgccgaagccaatgctatcaccaaagtggccggcagcacgaacaacagctccggtgctactatctatatcacggcagctccctgtatcgagtgtgccaagctcatcatccagagcaaaataaaacgggtggtttattccgagaaatatcgtctggacgaaggttgtcgcttgctggagcgagcgggcattgtcgtcgactttatagacatttccgatattcaggaataagttttttatgaaacgttcatccggttccggcagcaccctctcatacatccttatcgctgccatcttcagcgccgttggtgctcttgcctcacatttctatttcactcacaagaatccgagcgatctgaatgaagtgttgaatctgatcgacaggaaactatgtcgattcggtagatgtgccggaagttgcagcacaatatgattccctatctgctggagcagctcgaccctcacttc

SEQ ID NO: 289 - DNA (genomic), 1130 bp, PORYPHYROMONAS GINGIVALIS; double-stranded, circular
  misc_feature 1...1130
  hypothetical: NO
  anti-sense: UNKNOWN
tttcgntccgcttttccaagattttgcatgaaatgagagncaggacgtatagatgaaaaagctgtctttcggatcggagaaagcagagcatgccattcgggttatttttttcgcgcgaaaaaagttttcaacaacgaagacgagtttggaatgattctaaataagggggtaaaaagaagcggattttgaagtctgaaagttcagagacgagctttttcagttcaaaacatgcttttcagaagagaggataacgatctgtatataaaccgttttcgatctatatatagatcgttttcgttttatatataaatcgttttccatttatatatagatcggaagtcttttctatataaatcagaggctgaaaaaggccacttcgagaggctataaaaagaggcacccacacgattcgtggccgaaccatgcgggtgccttatgcctttaggggagtataagaggggttattcctacttattcgtcatagggatatgggctgtttatccgagtatcgagatggcatgataggctatgggcgcgaaagaatcggccggaaagatcgggggtataatggtgttcagtgtgtacatattcaattattgttgagtctattatccatgtatttctattcaagcaatcggctctcttggcatcaacattcaacttccgacagagagcttcatccggttggcaaaggtaacgaaaatgctgaagtcgaatgaatcgtaacagccaccgaatgttttactataaaacatttcatcggcaagggtttatctttgtggcggaatgaacggtgactatcggatatatatcatggctgcaagagcagatctgctgcatgtggcagcagtttgtcgtgctgtggaggctatcggcgcacgggtagtccaattcgtgcgtagggcttgatacatacgatccttgtgtgtggctatcggtagcctacaaaggagccaaatctctgttgataaaggctctgatgcctatggcccggacgtatccgattatgctcggtattcgcagagaggatacacctgtagggcgcatcggactcgtagctttcgatctggattcgacgcttgtgcgcacggagatcatgaatgaattggccaccgcacacggatgcctcg

SEQ ID NO: 290 - DNA (genomic), 512 bp, PORYPHYROMONAS GINGIVALIS; double-stranded, circular
  misc_feature 1...512
  hypothetical: NO
  anti-sense: UNKNOWN
gtgtattctttggattaggcgcataccttgtatatatgtccaaagcttatagctacttaagtgacgatccacnagtttgtatcaattgccatgtaatggggccttactatgccacttggcaacatagttcccacgcgatgcgtgccacctgcaacgactgtcntgtgccacacaacagtatttttagcaagtattatttcaaggcatcagatggtctgcggcactcctatgtatttaccatgaggaacnaacctcaacgcatgcaggccatatcggcaagtcaggcggtaatctatgacaactgtgtgcgttgccacgctcaactcaatcaagaatttgtccgtncaggaatgctgaccanggcggatattcgtactgcagaagagaaagcatgctgggactgccacaganatgtgcctcatggaggcaaaaacagccttagcgcaacgcccaacgggattatatcatacccaaagtcccctgttccgcagtggcttanggcctatataagc

SEQ ID NO: 291 - DNA (genomic), 712 bp, PORYPHYROMONAS GINGIVALIS; double-stranded, circular
  misc_feature 1...712
  hypothetical: NO
  anti-sense: UNKNOWN
ctcgggtgaaggaagtatgcgggagtaccggtggaactgaaagtcgtggctatgttggcagcaatctgtccggccttgcccatacccgaagttatcagccgaccgttagagccatgcacttgacgaacaatgaggtcgatagccgccttatagtcgttgtctgcagggatggtacggatggcttcagcttcatgtgccagtatttcggagatggttcgattgtgtatttctgccttcatgctcaataaattgcgctgcaaaagtatttatttaattttgcatattatgcttttaaggctctttctttgcactaaatcttattcgatttagaattggaagggtggctaagcaaaatgcaattaagctaaaacattgagaaaagccctgaaagcatgatagccggaagggtactatgtaacggatattccgaatttataaatggattatcaactatacacgctgccgagcggtttgcatgtggtatataaaccgcatgcgggcgaagttacatacgccggctttgccataggcgtcggcacacgccacgaaagctcgcggcatcatggattggctcatctgacggaacacatgctcttcaaaggcaccagcctgcgcaatagccttcagatcattcgtcgcatggaagaggtcggtgcncgagcttaatgctttcaccgagaaagaatccacctatgtgtactgcatcttttcc

SEQ ID NO: 292 - DNA (genomic), 758 bp, PORYPHYROMONAS GINGIVALIS; double-stranded, circular
  misc_feature 1...758
  hypothetical: NO
  anti-sense: UNKNOWN
aagccgaacatgcgtggtacgntgaccagcgtgtagcatagtaccggcacgtagatggtcagataggccagccccttgccaaagacgatacggagtgcgccggagtagtggctgatatcggtaggtacgaggtcgtgaaacttattcctctcacgcgccgtaccggccgagagtcctatgccgagcaggagcgtctgctgtatgatcaggatgagtacggcaggtagcaggaaggaagcgaaaccgacggtcgggttatacagtgccacgtcttcatagtcgatggggtaagagatgatctctccctgacgctcggtagctcctacgctgcgcgctatcttgatctctttgttcatctccagcgaaaccagtgtattggcaatgagcaggcttttgtagtagagcaatccgctcatatcgcagtaaagagagatatgggccttcctgccggtattgagatgttcggagaaatcctccggaacgtagatgatgccatagncattgcgcctgcggatttgctccttggcctcttccatatcggtgcagtgtcctacgatgcttacttcgggtgtggcatctacccttcgcaggtattcgcggctcagtgtcgagttcgatctgtccaccaccatggccggcacatcgcgtaccacttccgtggctgtatatatagctgtagaggagtgggtacaggaggggtactatgatgaaaaagatgaccatacccatgtctctgaacgtcttgcacagctcgtacc

SEQ ID NO: 293 - DNA (genomic), 4214 bp, PORYPHYROMONAS GINGIVALIS; double-stranded, circular
  misc_feature 1...4214
  hypothetical: NO
  anti-sense: UNKNOWN
gcaagatccaagatgcttacacacaggccacgaatggcaatatcagccacaagatcaacgtcagtgcggactacgacatcagccgcatgcttaccctgcgagcttattacgattgggatatgaaccatccgcttgtcagctcagcctccttccctatcacgaacagcaatttcggcgtcagcttccgtttcaatctgacgcagtagcctaacggcattacccacactcctcgtatcgcatttcagcgaaggccacctcccatctctgagatagttgtatccatagtattcggatattcattagtgaaatccatatcgtgaagaaagtatgaccgatatggataggatactatggtctcatatgagaggatactatggtctaacatgagaggatactatggtctcataaaagttagaaatggagaagagaaaatgccggatccctaccctgccacgaacattagatcgatcagatacgataatcatgcttcggagatgaatccaatcgcctttttcaagcagaaagccgatatgttgtgcgtttgagtgcgtctgattacctttgccggacattacttttcaaggattataataatgatcaatcgagcacttgtccgatcccgagttttgcaacaagcatatgtgtattaccatcgagatgatgctgatatacaatctgccgaaaaagagttgctcaacagtctggagcagacatacgacctatacctatattatctcctcttggttccggagctgacaagactgcatgcggaagccctcgaagccaacaagaacaagcacttagcgaccgaaaaggacaaaaaccccaatctgcgtatggtacgcaaccggcttgccgaaaagatcgagagctgcaggcctttgtgggtaagagccgaacagaatgctctgaattggcgttccgaagaagcttttctgcgacgcctgctgaaaaagatccatttgtccgagactttcacccgttatatgagatccgatgccaccgatgacttcgaagccgaccgcttgttctggaacgaactgatgcgcgacatcatcctccccgatgaagaactggcagaagtgatggaagagcaaagtatcttctgggacaatcaaatacaactcatcgaggaaaatcgagaccagaagaagcttccgacatagaggaggtggaacagtcggtacgacaagcagttgccgatggcaactaccaaacgatccgacaggaaaatgcacctatcgaaatcgtgaaggagttcgtcctcaagacaatccgacggatcgagcaagacaccgatccatcggctatcctgcttcctgcatacaaggagaaagacgatgccgtattcggcaccaccctactgcgcaatgccatcatcaacggacaggaatatcgccatatcatccgtgaaaatctgatcaactgggaagtggatcgcatagcggacatggatatgctgatcatgcaactggctatcgccgagctgctccacttcccgaatattccggtcttggtaacgatcaatgaatacatcgacctctccaagctgttcagtacacccaagagcggaacgttcgtaaacgggttgctggatgctgtggtcaaaagtctcagagagaaaggcaaactactcaaataagagcaggggcaaaacagctatcccccagatttgacaaatgacagacgacaaaaagattcgggcagccatcgtaggctacggcaatatcggtcggtatgccttgcaagcgcttagagaagctccagattttgaaatagccggcattgtccgccgcaatccggccgaggttcccttcgagctccagcctttccgtgtagtatccgacatcgagcaactcgaatcggtcgatgtggccttggtttgctcaccaagtcgtgaagtagagcgaacagccttggagatattgaaaaagggaatatgcactgctgacagtttcgacatccacgacggtattttggccttgcgtcgatcgttgggagacgccgccggaaaaagtggggcggcagccgtcatcgcttcaggctgggatccgggcagcgactctgtagtgcgcacactgatgcaggctatcgtacccaaagggatcacctacacgaacttcggtccgggcatgagcatggggcacaccgtagccgtaaaagccatagacggtgtcaaggccgcactttctatgaccattcctctcggaacgggtgtacatcgtcgcatggtttacgtagaactgcttccgggacacaacttggaggaggtatcggctgccatcaaagcagacgagtatttcgttcatgacgaaacccacgtgatacaggtagatgaagtggatgccctcatcgatatggggcatggcgtccgcatggtgcgtaagggtgtaagcggctccacacaaaaccagcgaatgtcattcgacatggagataaacaaccccgctctcaccggacaagtactggtctgtgcagctcgagcagccatgcgccaacaacccggagcttacaccttacaggaaatccccgtcatagaccttctccccggagacagggagcagtggataggaaaactttgttgaaaaagattactcaactaaacggttaatcggaacattatgacactacctgcattcatcacatgggatttcgatccggttctatttaccctcttcgggcaccctattgtctggtacggtttgctctttgcattggggctgatcattctgggcccttggatagagaaaaaaatgtgggaacacgagaagctggattccaaatggttcgagtccctggccgtctatgtctttgtaggtactatcgtcggagcgcgtttgggacatgtcctattctatgacccggcatactatttggccaatccggccaagatattcgtcacttgggagggtggcttggcaagccacggcggtaccatcgggatcattatagcctgctggctgtactcacgcagggtgacgcgcaaatctattctatgggtattagatcgtttggctgtgcctacaggtatcgtggccgccatgatccgtctgggcaatctgaccaacagtgagattttcggccgcccgacgacattaccttggggcttccgctttattcgttcggaagagtatcgtcacttggtaccgaacatggacatgggatgtcatcctactcagatatacgaagctttatgctatttggcggtctttgccctctgtatgtggctatactggaagcgcgatgctgcccgacgctactccgggctgatcgtgggggttttcctgacaggtatcttcctctctcgctttatcatcgaacgcatcaagatcgttcaggaaccatgggagctaaagctcatcgaatcagtcggcctgaatatgggacagctgctcagcatacctttcgttcttgcaggcatttggcttatcatccgtgccgtaaagaatccgattacgcagaaattatcataacaacaaataattataaaaatatccaagaatatgatgtatcaagttcctcaagtaacagactccgtttactacgtgggcgtgaatgaccgctcgaaaagtctcttcgagaatatgtggccgttgccatacggtgtatcgtacaattcatatctcatcgtggacgaaaaagtagccctcatcgacacagtagatgtttgctattcggagattttcttcaagaagttggatacagtcctcaaaggacgccctatcgactatcttatcgtcgatcacatggagccggaccatagtggctcgataggcctgctgcgccaacgctatcccaatatgcaaatcgtcggcaacaagaagactcatgggatgctcgaaggctaccaccacattaccgaaggacttctagaggtaaaagaaggcgacaaactctccctcggcaaaaatgagcttactttcattttcgctccgatggtacactggccggaagtaatgttcacctacatgccaacccaacaggtcttgttctctgccgatgctttcggtacgttcggtacactcgacggacatatattcgacaaggatatggatctctctttccgctgggaggagatgtaccgctactacgcctgcattgtgggcaagtacggcagctttgtacagaaagtactcaccaagttcaaggaagccaatctgcctgttcaatatatatgctctacgcacggcccgtttggacaccggcacacttct

SEQ ID NO: 294 - DNA (genomic), 660 bp, PORYPHYROMONAS GINGIVALIS; double-stranded, circular
  misc_feature 1...660
  hypothetical: NO
  anti-sense: UNKNOWN
aatggcaagcgtcttgcccttgaagtgtacaatctcttaggcgtaaaggtatttacctctcagctgcccgcaggatccggctcttatacgctgccggtgcgtctgcagcgtggtgtgcatatcttccgcatcacagaaggaggtaagcctgcgtttgttcagaagtatctgattaagtaataatgggagtacggccaaagcctgcacgatttggaggctaaggacgtttttcccaagataaaagaggctgcctcggagttcgacatagacttcggggcagtctcttcgttatattttcacgtcactgaatctgattgaggaaggattcggcatcatttctatattagatatagtgccgacatttgtcatccgaaagcagacagtaatactttatcatcatggcaaagatattggtggcatttaacaccgtgagcgaggggttcgaccggcttaccgctcgtcacgaagtggttttcccgcccaaagggcgcgattttactcaagaagaaatagcagagcgtatcgtggattgcgatgttctctgttccgtattcgacattccgatcggtagggatttgattgacaaaggcccgatcgcttaagttgatcgctaactatgctgtcgggtacaataatatcgatgtgacttatgcagcattc

SEQ ID NO: 295 - DNA (genomic), 569 bp, PORYPHYROMONAS GINGIVALIS; double-stranded, circular
  misc_feature 1...569
  hypothetical: NO
  anti-sense: UNKNOWN
gtcatcagtccgaacggtcataagtatatccgcgaatacaatgtggatataataccggccaccatctttcgcgtgggaggagtggtactcaagcgcgaacaagtattctgccactacatcaatcgtgccatattcaaatacacgctgatggaagcacatagcgatacgctactgcgctttcgtcccctgcttgctttcaggagcgtggcagctctcactcacgaaaacgggcagatcgaacgtggacatatcccggcccgaaacggcatagggatcagcctctacaagggttatccccatctcttcatgcagttcagcaaagaacccgaataccgcgaggagggatattggtacaaagacttcgaataccccaaggaaaaagagcgtggatacgagtgtacggaggatctttacatgcccggcacattcgagattcccataaaaaaaggagaatccatctactttgctgccggtctttgaagaggccaatccaaatacccttcgaacgacatttgtcaaggaaagtacgagagcgcattccacgccgaagaatttttcagctgccttga

SEQ ID NO: 296 - DNA (genomic), 924 bp, PORYPHYROMONAS GINGIVALIS; double-stranded, circular
  misc_feature 1...924
  hypothetical: NO
  anti-sense: UNKNOWN
gcgaaattaattgtaaatatgactgtcgtaaatacagggaaaatttaaggtaaggtaaaaatagaatgagaaaagcttgtttcatgggcctggggtatataggtctgccaacggcaattgtaactgccaaaagtggaatagaagtattaggggtagatataaacaccaatatcgttgcaaaaaccaattcaggaaaattgcactttgtggaagcaggtatggaagatcttttacaggaagttatacaaaaagaaacattccgtgcttctacaacaccggaggatagcgatgtttatctggttgtggtgcctacacccttcaaggccaatcatgagccggacattacatgtgtagaggctgcaacaagatcaatacttcccttgctcaagaagggcgatttatttattatcgaatctacctctccgataggaacaacagagcagatggctgatctaatctatcgagagcgtcccgaacttaaagaccaattatatatggcttactgtccggaacgtatccttcccggtaatgttatttatgaactggagcacaacgatcgggtcatcgggggcttaagcgcagaagcgaccgaacgggcaaaagagttctatgctcattttgttaaaggaaccttgcatggaactaatgctcgtacagcagaactctgcaagcttacagagaatgctagccgagatgtacagatcgcgtttgccaacgaactttctttcatttgtgacaaagccggaatcaatgtgtgggaacttatcgaactggccaataagcatccaagggtgaatattcttcagcccggtagtggagtaggggggcattgtattgcggtggatccgtattttaatctcttcggctttcctctggagagtaaactgattgccggtgctcgtgaatcaatactaccaggctttt

SEQ ID NO: 297 - DNA (genomic), 546 bp, PORYPHYROMONAS GINGIVALIS; double-stranded, circular
  misc_feature 1...546
  hypothetical: NO
  anti-sense: UNKNOWN
ggaatgttcgctcgagttacagatattactcacaagagtatagaagagttaaaaaatcttcgccatttgggatttaatggaataactgttggaactgaatccggagatgatctgacattattgcatatgaataagaaaacaacttcagcagaaacgatagaaaacctcaagaagtttgaagaggcaggcatagaatattatgtgtcctatcttacaggattggccggtgccggaaatggagaaagaaatgctttagctacttccgatatgtttaatcaattacatccttatatcatttcagttgtatcattaacgatttttcctgacacagttctatttcaagaaattcaacaggggctttttagagaggcgtctgaacatgagagattaaaagagctacgcacctttataagtaatctgaaaatcaatacgaatttcttcgcaaatacggtatctaatcctgttccattaacgggatacttgcccaatgataaaaagagattgatcaatgagctttccgatgttattaatgccgtagatgaaagg

SEQ ID NO: 298 - DNA (genomic), 360 bp, PORYPHYROMONAS GINGIVALIS; double-stranded, circular
  misc_feature 1...360
  hypothetical: NO
  anti-sense: UNKNOWN
aggaacgagtcagagccatcgaggcacagntgcgcgaagagttgtcccctgccattncgttcgatggtgtggccgaagnacgtgtcctcggagccatcggtgnagaggagatgaagcggcccgtggatatggccacgctgcagcagcgatncatccgagagggaatctgggtacgccccttcggtcgtctgntgctatctggagccacccttnatcatatcgccggaagatctatcgtatccttacgcacggacttctccgtgtactcggtcaggatcganccattncatttacccgataaatacaaganntatgtccgaaacaaangaaagactctgcatatacgccgactncccatac

SEQ ID NO: 299 - DNA (genomic), 447 bp, PORYPHYROMONAS GINGIVALIS; double-stranded, circular
  misc_feature 1...447
  hypothetical: NO
  anti-sense: UNKNOWN
aggccgctctggcagaagccgtgtggggagactatatagaccaagcggacaattatgactttgtctatgctcaaatcaaaaatctgcgcaagcagatgaacgatgcaggggcgacgatcgagatcaaatcggtatatggattcggttataaactcatagaaagagaagaagatacttgaaactatcctatcgaatagtactgcgttttgtcttgctgtcttcctcgtggtatttaccgcctgggtgatagctttctattatgtaatcgtcgaagaaatnaacgacgagacgaacgattcgttggagaactactccgaacatgtcatccgcaatatcctctccgacaatcctctttccaccggctgaaaacgaccttaacaacacttactccattcgggagattaccccacaggaggctatgcgtttcgctcacgatatttactaccg

SEQ ID NO: 300 - DNA (genomic), 597 bp, PORYPHYROMONAS GINGIVALIS; double-stranded, circular
  misc_feature 1...597
  hypothetical: NO
  anti-sense: UNKNOWN
gattctcaagaatttcaattgaaattttgacaaaaagttctatatttgcaacttaatcattagtacttgaagctctatttctcttaagtttcgcccttatatcagcgtagaaaattatcaccgctatggggaaccgaagacaaacagatgctgacaagtccgtatcgaaaacaaaacaaccctaccctatttcgcttatgtcgatcctgtataattttcgcaagatgccgccacgtcccgaccaaaatgaatccgaagaggcagaaggacggttatttgctcaagctatcatccaacggcagtacaccaccgaggacctttgtcgggacatttcggacaggtcgtccttcagctccggcgacatcacgggactgatgatagccatggaggagttgatattcgagtatctggcttcgggctatagcttccggctgggcaatatcggcacattatcggccaaagtaaaatcgcgcggagtaagagacaaaaaggaaatccgatccggttccgtccaagcccgtggatatcaatttccgttccacaccgcaagccaaacgacggatgcgcagcatgagtgtgaagcgcggtccgagcttt

SEQ ID NO: 301 - DNA (genomic), 508 bp, PORYPHYROMONAS GINGIVALIS; double-stranded, circular
  misc_feature 1...508
  hypothetical: NO
  anti-sense: UNKNOWN
ggctcccgagtatctcttcatcgtctttgtaacgcccgtagggccgtatttcaaagaaggattcaaaccgaccaagatggccatcttccgcgactatgaccgtgcagctcctctgggtacgggtacgatcaaagtgggcggtaactatgcagccggtatgatccccacagtgaaagctcacgaaatgggctactctgcagctatcttcttggatgccaaagaaaagaagtacatagacgaagccggtccggccaacttcttcgccatcaagaacaatacttatatcactcccgaatccagctctatcctgccctctatcacaaacaagagtctgatgcaggtggctcaggatctgggtctgaaggtagagcgtcgtccggtagccgaagaagagcttgctactttcgaagaagcaggtgcttgtggtacggcagccgtgatcagccctatctccgagattgacgaacttggagaacaacaaacagtaccgtcatcagcaagggacggc

SEQ ID NO: 302 - DNA (genomic), 527 bp, PORYPHYROMONAS GINGIVALIS; double-stranded, circular
  misc_feature 1...527
  hypothetical: NO
  anti-sense: UNKNOWN
atatcgaccgatgcgaacgaaacgacaagcgcaccatcgacaacgtcatttatcgcgacggcaagtccgctccgttctatatcaaacgtttcagcgtcaccggtgttacgcgagacaaggagtacaaccttacgcaggaaacggccggtagtcgggtgatgtatttcaccgccaataaaaatggcgaggcagagaccgtgaggatcatcctcaaaccgaaagctcgccagcgggtactttctttcgagaaagactttagcaatgtcgccatcaaggggcgaagcagcaagggcaatctgctgaccaaagcagaggtgcacaagatcctgttcaaacagcangggtgcttccaccctcggagggcggaaangtttggttcgatcgggacgtgatgcgactgaactacgaccgagcangggcgaatatctttgggcgaaattcccaaagcctaaccgatttcgatggcttggtaaatcctttgggattaaaccgggggacctggcttattacctaacaattcccataag

SEQ ID NO: 303 - DNA (genomic), 544 bp, PORYPHYROMONAS GINGIVALIS; double-stranded, circular
  misc_feature 1...544
  hypothetical: NO
  anti-sense: UNKNOWN
gatcccctgcccgaattttcgtatgcctatcgcaacaaaggtacatttttcttttattgtaaaggtctatttagcatttttatgcaggcacagcagcagccattcgacccatcgtttaccgctccggatcggcgtccaggcagaataccgacattccgaagagctgagagagaacggggagaaaatcgagtttacgctcgagaattgttccacccaacgcccctaaaaacgtggcgcgagatttttttcgttttggtgcgggaaggaaaaaatttacgcgcgagaacgaaatagttttggttcgtgtttttcaggaaaacacacgccgcaatctgctcgtttacggttcgtaaatcgcgaacgaaaatgtgcgaagaaaaggaaaggatacttctcatgtatcgattgttcagtcggattttgagtgtgcccgtatcggattggtctgcggctatgctccgctttattctttgcctttgtcctaaatttgcaccacgtnggttttatacgggagagaactactcccctcccctactgactcaaa

SEQ ID NO: 304 - DNA (genomic), 490 bp, PORYPHYROMONAS GINGIVALIS; double-stranded, circular
  misc_feature 1...490
  hypothetical: NO
  anti-sense: UNKNOWN
gggaagaactgagcattggggaatctcttcacatagtctgatactacgtcgttaccgctgtcacggaggtcaagcatgcatcggaatttctccggtgtgttgataccgtcggggtcgtaaacatagccgtcaggaccggagatcgtaacaaccttaatgcccaactcggtagctttctgagccacaccccaagcaacgttaccgaatccggagatagcaagagttttgcccttgtagtctacaccgttttgcttacacatgttctgtacgaagtaaacagcaccgaaaccggtagattctggacgcagacgagaaccgccgaactcgaatcccttgccggtaagcgtacctgtgtgctcgcgagcgagcttcttgtacataccgaacatataacctacttcgcgaccgcctacgccgatgtcaccggcaggaatgtcggtgttagggccgatgttgcgccacaattcggtcatgaagctctggcagaaac

SEQ ID NO: 305 - DNA (genomic), 2108 bp, PORYPHYROMONAS GINGIVALIS; double-stranded, circular
  misc_feature 1...2108
  hypothetical: NO
  anti-sense: UNKNOWN
tcttcagtcttggcaaagatgaactgactcagaaaatgatggtcaattcgaccggacgcaaatgggagttcactttcactacattggttactttcggaggagctctctttgcttcgtttcctcttttctatagcaccagcttcggaggagcatattgggtatggatgctgatcctcttctgcttcattatccaagctgtctcctacgagtatcaatccaaacatggtaatgtatgggggaggaaaacctaccaaatactgcttttcatcaatggtgtactggctccggttctgctcggaaccgctgtttccacattctttacgggcagcagcttcgtggtaaacaagatggcgatgttcgacctctccggcggcaaccagatcgtttctgcctggcagcccttcaatgggtggcaactgagaggccttgaagctgttttgaacctgtggaacgtggttctcggattggctgtattcttccttgccagagtatcggctctgctttatttcatcaataatatcgatgacgaaagtctctatgcggcagccaaacgccgactttgggccaatacggtcgcattcctgattttctttctggcatacatagctttcctgctgactacggaaggatttgccgtgaatcccgtttccaaagaggtgtatatggagccatacaagtacctgtacaatttcttggatatgccggccgttctggctgtattcctgttgggagtaatcctcgtacttggcggtataggtttgactctactgcgtaaaggcttcaaacgcggaatctggctacacggtacgggaaccgtactgactgtgcttgccctactacttgtagccggttggaacgatacgtcttggtacccctccacatacgatctgcaaagttcgcttacgatcgagaatgccagctccagccatttcacgctgaaggtaatgagctacgtctctctccttattcctttcgttttggcttacattttctatgcttggcgcgcactggacatttcgtaaaatcacaaaaaaagaaatggagcaggacgatcacgtctattgatctctgacagataattccacaatctgaggctgtgtcattgaggttcgatcccttgatacagcctcattgcttttatatatttcggcaataatcatgaccgacgatttgaaaagacggctatatttacctgaccaaacgatagcaatatggctcagtcatcatatcaaaccgcaccgcatcggataggcttggctcttagcggcggagcggccaaaggctttgcacattcgggagtactccatgctcttgaggacaatgggattcgtcccgacatcatagcaggtacgagtgcaggagcgttggtagctgcactctatgccgatggatacaggcccgaagagattccacaattattccgaggcaaaaatttcagattcctaacagagtggcaaataccacaaagaggtgtattcagcatccaacgcttcaagagttttcttcgctcgactttacgccacaagaatatcgaagacctaccccttccgatcagaatagtggcaacggaccttgaccgtggagttgtcaaagttttttcacaaggctctctcgtcgagactgtcacggcttcctgtagcattccgatcctattcaaccctgtagagatagatggaaccacctatgtcgatggaggactgttcaaagaccttccggcttctgtcattcgtgaagactgccgttatctcataggagtacacctcaatcccaaagagccttccgactataaaaagagtcttttcggcattgcagagcgttgcttcggctacatcttccgagcgaactccctgcccgatcgcaagctgtgcgatttgctgatcgaatcaagagaaataatcaagttcaaaccattccacgtggagccggcagaagaaattgccgctttcggatacaaaatggccaaacaagttcttaaaacgacctcgataacgcggaatccatgaaaaagggcgaaaagatgattgtctattccgtgctgccacgtctctttgacaaccgatgccaaacacgaaagccgggaggcgacccgatggaaaacgggggtaccg

SEQ ID NO: 306 - DNA (genomic), 3479 bp, PORYPHYROMONAS GINGIVALIS; double-stranded, circular
  misc_feature 1...3479
  hypothetical: NO
  anti-sense: UNKNOWN
cggaatgtccaagtgtatgtgaattgttgcagacggatattgtcccgatgtatgcgaacgaggctgttggcattgatggtctgatcggagaaggggatatttaccagactgtctaacgtgtattcgatgatcttgtcctgataaatggtgtccactacgactacgcctatatcggagcctgccagaattttcttttgcagtttcttttgcaaagactggatattctcgtacatctcagtgttcagttctttcaattcgctgatagtggcgatgaacgatttcttttccgcatagagatttccattggcatctttgaggtaacgaatggagtccaatgcggcttccacattgtgctgagcgatccgcaatttattacgtacatctctattccacaagaaagaggtgataagcagtatggcgagtactgcgatgattgatccgatgataatgttctttttgttcatatccttttccgtttggttgattaataagagttgtcgaattctgaatgaaaaatttcgtttagagaggtcaaattaattttcagatcagcggttgtatccgaagcgaatcgggtaatagttttattaccaccaatgggaaatgatgccggataaggcgaaccctacaacttaatttgtccataagcttgccaagcttgtttcctctgatgcaaatttgatgaaaaataatatgaaaaacaacattttgttaaataaatttcttctttacaagtccgaaggcttggcttatggtattaccgaaatgtttagccggaatttggccgaattattatccgataagatcatgattgtctatcctgatttcgatcgggatagcttcatccaaagtattgaaaatcatgtcgttgggaaaacatatacccggcgaatccccatcttcgcctcactgttgaaagagcatcttccggaagattacgagagggctttgtccgttttgacaggtatttggggagaagaaaaccccaacgaaacgggaatgtttaaccattctattggatcatgcctatcgggaaatctacccaagattatagtacacattgtgagtttatagagtttccgggtaaaattgctctccggtacgattccctttgcgggaagatggcggaaggcaaaagtgtatgtcgcagtcaaaaatgacatcctacaggaaagaagaaataagaggttgatttatagtgcattatatcttgaggaaagaaagctcaaaatgctcctgaaacaaactatatagttcggtcaaaccaaactatatactttggtgaaactaaactatatagtttggttgaactaaactatatactttggtcgaaccaaactatatactttgataaagccaaactatatactttggtttggccatggttttcagcctctgtgtcaatgtccaaaagggagttggggaaacgatacaatttccttctaagtgcctctaaaacaatcacttctgtctttcgtaattatgctgatagggattattggtctttcggcttttcttttggaagattgtcgagatagggacgggaggaaaagcatccgatggggacaaaagaaaaaggtgcaaactgcatcgactgccggtttgcaccttctttttgggtggagtatagcggactcgaaccgctcacctcgacactgccagtgtcgcgctctagccagatgagctaataccccattggtttattgcgctgcaaagataaagagttttctctattgtccaaatatcgcactaccgttctttgccgaatgtaatgaacttattggcaaggaaattgataatggtgaaaaaggccattcctatcaggtggttgtaatacttgtcgtaggaggtggagtattcgttgagccacatcaaaagtccgtattggagtgcatagcatattacgaacatcaggatgaatggtacgaatgtttgcctccaagaggtccggctccggaatgtccatttacgattccaaatgaagctgttgatgagtcctgctatataaccgatcagattggccggaccgtctttcataccggcgattttgagtagcaggaagattacaatcatggaaatgagcgtattggatacgcccacgataccatatttaattagttgcaggaaggtcgttttcttcggcatatttcttcagggctacttgggcgccctgcggggtaagcagttgggtattggtgatgataaacgtggtggacagaaagtggccgaactgattgcactcggcgatgaaggacgagaagaagtttcgcagatcatagttgatcgggacgaggaaggtcaggagcaaatagttgttgtgcatctccagccgttctacttcaccggatgctttgccgatacggtatagcagctccttctctatcagttcttcctgatagtgttcgaagtcttgcagtttgtccgtatggagaaaggccatgaagcgcatcatgccatcgtggccgcccagaccactggttatgaccagttgcttctcgtctaccagatcggataggatacctatgcgagcttccagctgggccatcaaagcccaaggcctcatcgagtcgggagcggattcgagatagcgttcgataatcctgaatacagtgatgttgccagtgatggcaaggcgcagcagagtcattttcttgatgtcgtccgaaagtacgggatcgaacaatagctgctctgcatcttggacttcgttctcgctaagctgtatgccacgtctgcgcatctctgccgacaaacggaaataagaggcttgcaattctatcggaataggctcatcaagctgatggacgtgtttgagagcttcttccgacaggccttcgagcggtgattgctgtctttcttcttccatgacgattgaggggcaaatattatactgtggccgtaacctgtttagaagatctttatggacttgatagccatattcgatacatcaactgtccggcgtgagcaatgataggcaaagattagacaatgtgcaagacaaaacggaacgacgagagaagaatacgaatctcctatctgttgaagaatagcggatgtaccgtgggtctgctttcggctaatctccccttggcatatgccaagcatccattgacaaaagtgtatgcgacactgtgactgaaggtgaagccttcgaaaggagaccatccgcagaggctaagtatattatccgcagatacggtgtgaggagatgacggatccacaagcaccagatcggcatagtagcccggacgaatgtatcctctcttctctatggcgaagagagtggccggtatgtgagccgttttgcttactatttcttcgatgctgaatatgccttgattgcagagttcgagcaaggcgagcaaggagtgctgcacgagtggcccgccggatgcaacctgcaagcaactgccttctttttctcttaagcagatgccgggcattgatccgtagctataatatcgataccgttccattgc

SEQ ID NO: 307 - DNA (genomic), 459 bp, PORYPHYROMONAS GINGIVALIS; double-stranded, circular
  misc_feature 1...459
  hypothetical: NO
  anti-sense: UNKNOWN
gtcgaaaattcggaaaactttacacaaaacgcaaaaacaataacacactaataataagtgtttttatgaaaagttttcggaaaacttttcaacaacgaagccttttcctattgtccaattaatatatacttcataacattgcaggcacaaacagaagttatttacataaaacaccatgtcacgcaaaacgtacacattcgacgaggcatacaaagcctcgcttgcctattttgatggcgatgagcttgccgccaaagtatgggtaatgaagtatgcgctgaaagatgcccaagggaatatctacgaaaaaagccctatggacatgcacaagcgtatagcctccgaaatagctcgcatcgagaaaaagtatcccaatcctctttccgaataagagctgttcgatctcttcgatcacttccgctacatctgtgcctcagggaagtccggatgaccggtatc

SEQ ID NO: 308 - DNA (genomic), 459 bp, PORYPHYROMONAS GINGIVALIS; double-stranded, circular
  misc_feature 1...459
  hypothetical: NO
  anti-sense: UNKNOWN
ggcgtaatgcctgatgtccatggactctcggcacaggatgctttgtacatgctacagctctcagggttgaaagtaaggacgaacggatggggacatgtagtggctcagtccgttccgtacggctctaaagtgaaagtggggcagactgtcgtcatagacttatctatgtaaagaacaaggaatgggaatgaaactcgaacaatatctctcggaactgcggccgatagctgtcattggcaatatcgaacaggaagtatcagatattgcatctgattctcgcaaggctacggacggtgcactcttcgtagccgttcgtggaacactgacagatgggcacagatacataccgcaagcatacacacaaggctgtcgcgcctttgtcgtggaggaccttcccgatgaaaagccggaaggatgctgttttgtccaagtgtcggatacagccgaagcatttgcttt

SEQ ID NO: 309 - DNA (genomic), 1083 bp, PORYPHYROMONAS GINGIVALIS; double-stranded, circular
  misc_feature 1...1083
  hypothetical: NO
  anti-sense: UNKNOWN
gaagaggaagctttcgatctgggacataaagctgtgagagaacgtttcggctctttcgtggaagatgccaaacgattagggcgagccatccgcatcggagtcaatcatggctctctgtccgaacgtatgcttacgcgctatggcgatacggctgaaggcatggtacaaagctgcatggaatacctcgatgtatgccacgaacatgagttcgacgatgtggtgatctcgatgaaagcatcgaatactttggtcatgacagcagctgtacgccttcttgtggaacgaatggatgctgcagacatgcactatccgcttcacatcggtgtcaccgaggctggcgatggtgaggacgggcggatcaagagtgctgtcggcataggttcgcttttggctgatggcattggcgataccattcgtgtttcactgagtgaggatccggagcatgagattccggtagcccgcaaattgcttgcctatatagagaaacgtaacggccacccgtcggtagctgttcctcaaccagatcgttacgatcgggataaactccggcgccaagaaacatatgctgtcggagactttatcggaagtaagcacattccgattgtcatatcggaccgcagacagggagatgatcatttcgataccgaactcttgcctgacatcgtactcggggccgatggtcggtattatcgtgaggatatgctgctggaaaatatcgtttttcgttccatccgacaggatgatctgactgacgattgtctacagactattgaagcaatctctgacacagttattatccttgaatccgtgggtatcaatcccgtagctgaatggcgtgcaatgcttcatcgtttggagctggcaggatgtcgatgtcctgtcatcctgcaccgcaggtatgactgcaccgatttggaagatcttcagctacaagcgtcggctgacatgggggctatacttcttgaagggcgaggcaatgggcttatgattactgcagacaaactgcctcggtcgctgtgaatcacttggctttcggtattttacaagctacaaggttacgtatgagtcggacggaatatatca

SEQ ID NO: 310 - DNA (genomic), 1282 bp, PORYPHYROMONAS GINGIVALIS; double-stranded, circular
  misc_feature 1...1282
  hypothetical: NO
  anti-sense: UNKNOWN
gtaggcaggggaattttggcccgatccggcacgggcacggcaccggcattttgtctgaacgcttgttttagctgctatagacgagctgaaaagaggagtcttggttcaaggaggattgtcgcgtatggatgtatcgcggagcttgggcagagtgggaaatagactacatagagatggccgtcccgatgagtccggacgaactccgcttcaaacgaaacagcatcctcaagcatcagtcgcaaatggagtccgcccccttccttggcgatgacgaacggctcttctggcagagggcggaagatcggaacagacaaacggccaccctgtacgaaaaactcggcttggcctcctatgaagccatagaggcattcgtacagtataggcctgtcgaatagagaagcggtataaatacaataagagaggcttccttcacttgtccattcgggacggagaaggaagcctctttattttggtaccgacctttgccaacggcaggcggggtttatctccgggcgagctgatgatcgatgaagatcagattctgctcctgagagagacggatcgtttcgacgatttcggcagcagtggcttcctcttctacctgctcgcggatatacttccagaagaagtcctgtgatgccatatctccggcttcggaagcagcccttacgacagcctcgatcatttcggtcactttgcactcgtgttcgtacacctgttggaatacctccaatacagagccgaacttctggggcacggcatcgatagcttctatcttcacctcgccgccacgcttcaggaggtagtccatcatatcgtaggcatgttccatttcctcgaggctctgctttttgagccaatgagcaaagccgttgtaccctacctgcgcaaaatgcacagacatggacaaatagaggtttgaagaccacatttcggccttgatttggtcattgatcgctttagttacgttttcgcttattttcattgttctgtaatttattattcgggcctacacagtnaaacccgatgattattcacttctatattctctaaccgaaaaatatccccttttgttcacccctcggagcaatcttgccacgccttccatattcctgcctgttccggccgaatattcaccggcgagagaacatagcactttatacttaaaagtcttacccctttataccataaagcctccatacttgataatatgaagatcccttgggagtctcgatggagatcccttaggagtctcgatagggatcccttaggggtctcgata

SEQ ID NO: 311 - DNA (genomic), 6321 bp, PORYPHYROMONAS GINGIVALIS; double-stranded, circular
  misc_feature 1...6321
  hypothetical: NO
  anti-sense: UNKNOWN
cagcctgacggatactacttacgaattacaaatcccttctactttgaatgggcacagaagcaccacttgaatctggaatttcgtcttatttccgagcctaagcgtgctcacggacatttcaattacgctgtgtttgtggatggccatcgtatcggtagcggaatcggcatgaataagaaagaagctcatcagaatgctgcacatgatgccctggaaaagttgaagcgtgcgcgcgattaccgacaaaaaaagaaatcgtcatcatcttcggagccggaataaagactcgcactctgcacacaataacttgtgctgcattttcttattgtattttcagaaaaagaagcaaccccaatgacactccactttgtgtcgttggggttgttgctttagaagtaagtgatcagattatttcttagctgctttgttgagcttgcgcttttggatctcgtaggcaaggggtgtagcaacaaagagcgtagagtatgtaccgataacgataccgagcaggatcgagaacgtgaaactacgcatcgtagcacctccaaagatgaagattaccaacataacgataaacgtagtcaaagacgtatttaatgttcgacccaatgttgaattaagggcatcgttgatcacctgatagcgatctctgttggggtacaatttcatcgtctctcggatacggtcaaatacaaccacggtgtcattgagcgagtaaccgatgatagccagaatagcagcgatgaagttctgatcgatctccatggtgaagggcagaatcttccacagcaacgcatacagagcaataatgcagaatgtagtagcggccacagatacgaataccccggcagagaaagaaatgtcacggaagcgaatcagaatataaatggccatgaagatcatcgataacagcacagcccaaatagcacctctcgtgatgtcactcgacatactgggacttactttctgagagctaatgatattgtccaagaactgatcagcagtaggctgctgggtgtagaaacctttcaggctctgatacaatttgtcagtaatctctgcttcagtttcttcgctttcctcctggatcttatagttcgtagatatacgcacctctgtcccttcagtaccgatggaggtaaccaataccttttcctgcaggggagaagacaaggccgaacgaacggcttcggaagatacaggctggtcgaatttaactacgtagttacgtcctccggagaattcaatacccctattgagaccgattgtaaatgaagctataagtcccaaaacgatgataatcaccggaatgataaagccggtcttgcgcttacccaagatgttgtatgagggattgacaaggagattgcgagtaatgctcgtagtgaatgtaatcttatccaaacgaccttttttcgccagtttctcgaagacgatacgagtcaagaagacagccgtaatgaaagaagcgataagaccgataatcaacgtagtggcaaaaccgcgaatcggccccgtcccgtagaggaataggatgataccggtaataatagtcgtaacgttcgagtcgaagatggcagagaaagcgttgccataaccatccgtaacggcacgaatcggagtcttaccggcacgaagctcttctttgatacgctcgaagataagtacgttggcatccacagccatacccagcgtcagcaccaaacctgcgatacccgagagggtcagcacggcatggaaagaagccaatacgcccaatgtgaagaagctgtttacaatcaatgcgccgtttgcgataagacccggcaagaaaccgtaagccagacacatgtaacacatcaggataaccaaagcgagcaggaacgacaagaatccggctttaatggactcggcacccagcgtaggaccaatcacgttttcctgttcgatgcttaccgtagcatccattttaccggagttgagtacgttggcaaggtcaccggcctcctccacggtgaagtgcccggagatctgagagcgaccgcccgtgatctcatcattcacgttcggagcagaataaaccacaccatccaaaacgatagcgattgcccgtcccacgttatcctttgtgatacgcgcccatttacgagcaccttcttcattcatcgtcatcgaaacgatcggttcggaacgaccgaagtcattttggatatcactcttggcggaagtcactacatcacctcccaaatcaggatctcccgtacgattggtacgaatagcatagagttcgtagaggtcggtctcctttttggtttcggggtcttcgattgctttagcaccccagaggaaaagcacatcttcacgtgtaaccttcagatcgtgagcttgctggagcatttcagatatctgagccatattagcacgacgagccacacccactactgcaccgccacgattcacgggagtaagcagagagaagagtgcgtctttacgagtagcatccttggcctctttttgtgctacagtagcagaatcagctacagcttgtacagcagcagaatcggctgttgcagctacagagtcagtagttgcaggctctgtttccggggtagcatccgtgttgttcatagccaattcgctcagacgatcattggcagcgatcaagtctccgctgacctcttcgaatttgtatgtacgccagaactgtaggttggcactgcgttgcaaaagggtacgaacacgctcagggtctttcactccggggagttcgacaaggatacgcccttgcccttccaatcgctgcaaattaggtgcaaccacaccgaaagcatcgatacgagcacggagcacattgaacgaagcttctacagcactattatatttttctttgagcagacgcactacgtctgcatccgtagactttgcggtaatctggtcgcgaaggtcacccgaaccgaagataacggccaagcgaccgttgggatcgagcttgcgatattccttcacgaaaatatcgatgaagtcggattgctccgtgctcttggcagcattctccagagctttgttgaagttgggatccaaacttttgttagagaggttacgaagcagatcgcttgcgttaagtttcaagataacgttcatacccccctttaagtcaaggccaagaccaatttgctgggcttgagcttctttcagcgtgtagccgaaccagaccttctcattcgacatggaatcaagataggccattccggcaacatcgcccatcgccttagccttcttttcgtaacggttcgtaacgaaagagaatgacaggtaaaacgcacagatgatggccagagccgatgtgataacaatcacaaatcctttgttttgcattttgtctgttacttattttattgttagatttttttcatctatacaggcatattcatagggcgcaaagttacgtttttttttacactatctctcactttatatatagaaaatagccgatgattcgggtcatcggcagcaaaaacagtgggacattgcctcggtacagcaaatgattgggtggctctataaccaagagccacagcaaggatactgcagcctacccacttccgagctgctttaagagcgatttttcgaaagcgatatatggcaaaggcttctgcttcatatggaaagagcaaacctgccggtagccaaggcgacggaaaaggctctgcgcagccgtattggggctatacgtatctatgcgtatgcaagtgcccccttgttcgcgagctatcgtctcggcagagaaaagcatggcagcggcataccccttgcggagcagagaggaatgaacacccaggcggtgtatcgtataggctttcccttcggtctgccatggcaacgagccgtattcggccggcatctgatcattcacagccatcacccccaaaggagtacccgctatatccaacaggaaggcttctccacgggctatatcctcttgagcttcggtctcgcccggatatgctccctgccactgaggattgtcggaagcaagcatcgtgtgccgggcatcctcccatagggcaagaatgctgtcgtaatcggatggaagagcccgacggatccgataatgatcagtcgagagacaatatcctgtctgcttgctgtccaatgctttctctgtcatgtgaaatcaataagatggttgcaccgtctttgtgcctttgggatacagtctgttgcacgagtgcttcagccgattcgtccaaatagctgttcggttcatcgagtacgaggagttcgggacagcttacgatagctctggccaaaaggacacgctgtagctgtccgccgctcaaatccgatatggggcgtttgagcagatcggttatccggagatcggaggcagcaccggccagaagttctttgtgcgaacctcgattaccctccccaagcaaaccggatcgaatgacctcctccacgcgaataggaaaagctctgtcgatacgattgagctgaggcagataaccgatcgaaggccttacacacggcattccctcccgattgtagaacgtaagactccccgatcgcagtggcagcaggccgattattgcctttacgagggtggactttcccccaccattgcgtcctacgataccgagaaattcgccacgaacgatatcgagcgaatagtccttgaatacatttttcggtccatagccgaacgaggccgacttcaggctgagcaataagctaccgttcatgagccaaagcgcgagcaatatgtaaaatttcctcctcccacgagctgcgcagaggattgatccttaccggacgagcaccgatctcgcgtgcgatgtcctccgcctgacgcgtttcaaattcgggttggataaatacgattctgacaccatcggcacgtgcctgatcgatcacacgacgaaggtgggcagccgtaggctctttcccatcttcctctatgacgatctgccgcaggccgaactcttgggcgaaaaagctgagcgatgggtgatatatgacgaaggctttgtctgctttgccattggcaaacatggtatcgacgagtctcttcacgctgtcgatacgtccgttgagacggtcgtgccctttgtcccatttgtctttctcgttcggataaagctccacaagcgcgtcgtatgcagcacgactgagtgcctttgcccctaccacactgctccaatagtgcggatcatgggcatgcaggtctgtatgagaatgatctgtgcaggagccgtggagatctgcacttccggcatccgccaaggctttgcccatttcgaaaagagggagcttagggttattgtcccgaatggcagcgagatttctttgctcgaaccccagtcctcctatatagaagtaggcatctgcttcggacaaacgcttcatcacggtaggcgaagggtcgtattcctccggattgctgccggccggtaccaatgccaccacctgcaccgacttatccgcaatggactcgatgaagtatttctgtggctcgatggtcacagccagcgtacgatcggagcctgaagcagtaccccctccacaagccggcaaagcagtagcggcgaggatgaaggccgggaaaatcgtgaaaaaaaaggtagctccccgactccaaaagttcgaggatacatatcgtgaaagtatcgttctgatcatagattgcaaatctaccaaaaagaaaggctgtgtcctaaggtttcacccttattcgacacagcccgtagacaacttttttattcaggcaaatgctctttgaggcactctgcgagaattagcgacggataccgagttccttgatgatggcacggtaacgctcgatatctaccttgatcaagtagtcgagcatacgacgacgcttacctaccagcatcttcaaagaacgttccgtggcaaagtctttcttgttctgacgcaagtgctcagtcaaatgcgcgatgcgaaatgtgaataaagcgatttgactttcggggctaccccgtgtccttcactgacttgccatacttctcgaagagttctgcttttttagctgaatccaaatacattttcttccgttttttaacgtgttaaacaataactacttccgctactacggtcgtagatctggccgcaaagataatataattccctataccacagcgcgaatctgtttcttcgctcttgttataacgatgccgttggacgtacggatctacattgggccaagcattcaaggaaaggtgaactcgcccttctttgcatttttgggtccaaaaacaagccaagaaagccgagattctatttacttttgtgcactctttgaacgaaaatacagcttat

SEQ ID NO: 312 - DNA (genomic), 677 bp, PORYPHYROMONAS GINGIVALIS; double-stranded, circular
  misc_feature 1...677
  hypothetical: NO
  anti-sense: UNKNOWN
cagcagttcccggtagtagaaaccatcacagcataatgctcagccgaataaccagcatcttgcgcacttacccaatacttgacaagcttggctccttcgagtctgggtgtaaccaaatagttatccggagttaaaacgccaatcatcggtaagtacgaaggggatgcaatacacttctcactgtcatgtccatacatagtccaaggataatagtcccaattaacattgtcgccatcagcatcaatcaacaaccagccttcaggaatacttccggcctcaaagccttcatataagataatgtccgattgagaatcataaatcagcttatcgcaaaccgattgggactcgatattgtcgttataaacggcagtgacacaatattccacttccacctgatcgtctcgtgaagaataagtctcatcgatatactccaaaacagtcgggtcttgtatgtgaacaaggagcgagccgtttgcatagatattgtagccggcaagctgcaatgggtctttatcatcagtcttatcgggttcgtaagccgttaggataattccactttaatcgtcccttgttgttttcaataagcgagacaacgaaatcggtaacaggttcgggctctgatgcaggagtcccgaatccaggtgatatcgtccaacttcaagaaatattatatcggt

SEQ ID NO: 313 - DNA (genomic), 579 bp, PORYPHYROMONAS GINGIVALIS; double-stranded, circular
  misc_feature 1...579
  hypothetical: NO
  anti-sense: UNKNOWN
ccccgtaaagcagtgatcgcatcggaatcagccaagaaagtattggctgagaacctgagacaacgcgctcacaaaatcgctcagatcaagaaagaggctgaagaaaaagctgcatcaatgcagggcatcagcctgacgatcaaggccaagacaagcagcacgggcacaatcttcggatcggtaacgaatatccagatcgcagaagagctggcgaaaaaaggcgtggaagtggatcgtaagatcatcgtcctcaagcctgccgttaaggaagtgggcaactatacggctgtagtgcgcctgcacaaggaagttactgtagaaattcccttcgaagtagtttctgaaaatgaaactatcatagaagcaaagccggaagaagctcctgttcccgtagcggaagagccgaccgctgagacagaacaagcagaagttgctgcttgaataagcacactgagattgttcctttttagcctgtcctccaatgcttggatggacatggataaaggaataacagctttgtcagcattcagaataaaacgatatgagaaggtggaccaaaacgcatagttttggctcacc

SEQ ID NO: 314 - DNA (genomic), 3190 bp, PORYPHYROMONAS GINGIVALIS; double-stranded, circular
  misc_feature 1...3190
  hypothetical: NO
  anti-sense: UNKNOWN
gcctttgctctacggccaagaataatgtgggcgaagaagcctacgacgaccaaaaaaagaccgatcatcaagcttttgtcgctgatcgaattcgtgaatgcggggatggccagtaccaaaacgccaacgagcaatatgatggctcccaagtattttccgattccttccattgtgagtatgttcgttttatttgttttcgtttttatctctgcaaataaaacaataatctgccgaatacagaaattattgcacgaaagattcattacttttgtccgtaatcaatacgaaaaagatgaatactatcggacgctttctttttctcatctatttctgcctgatcggcgcccctcttttcctcctgctcactatattgacagcactgactaccactgtaggctgcatgctgggaggcagtagaatattcagttattatcccgggatgttgtggtcgcgatgtacgctattcctctttttgtgccccattcgagtcagagggcgagagcatatcccgggtaaagggcctttcgtcgttatggccaatcaccaaggcgcttgcgatattttcatgatgtacggctatctcggtattcctttcaaatgggtattgaaagaaggtattcgcaaattacctttcgtaggctatgcatgccggtcggccggattcgtatttgtcgatgatactcgcccttcctctattgctcacactatggatcaggccaagcgtgttttggcggaaggcacttccatttttattttcccggagggtagtcgtactcgcaacggccggctggctcgctttaaaaagggcggcttcctgatggcggacgaattgggtgtacccattattcccgtttcgttggatggctcgtatcgcgtgcttccctcagggaaactcatcccacgccctcatcgcttgacgctgacgatccatccacctctgtccgttgcagattttggagagagaccgttatgtatatccgaggcggtgcgggaaacaagccgacgaattgcttcggtgctaccggaagaaatggctgcaacccaatcgaagtaacgaggtaaagccttatggatcatagccaactgaccgcccaagcagtaactgcgcattttgaaagtatcggtaatcctgagcgtgccggacagatgcagcggttttttaagactgctccgggcgaatatgctgagggagaccttttcctcggaatatccgttcccgacattcgcgcttatgagaagacacataggccttggagggtggaaatcctcgctcttttgctgcaacagccttatcacgaggtgcggcatctcgcacttatcggcatgaccgaactatacagacgtgctcggtcggaagcagtacgggaggggctattagcctcctatctgagccatacgactatgatcaataactgggatttggttgatgtatccgcacccggaatagtaggcgaatatgtccatgctcatcccatcgagggcaatgccttgctggatagattggccgattcatgcttgttgtgggaacaacgaatagcgatggtagccaattggcgactgatccgatacggagagtacgaagctaccattcgcattgccgagcgattgctccaccacccacacgatctcattcataaagcagtaggctggatgctgcgtgagatgggtaaaaagcaagaacggctcctgcttgctttccttgacaaacatgccgccactatgccacggacagctctccgctatgccatggaaaagctcccgtccgatctgcgctcttactacctgaccaaagggaaataatctacctataatttttatatatcatttataggcggagctgcgaaaaaagaataagccgagcaaaataacagacggaataaatcaaaaataaaaggcaaatattgagtcaatatctgcctttttctctttttccagtcggggtgactggattcgaaccagcgaccacacgccccccagacgcgtactctaaccgggctgagctacaccccgcttgcttattgcgttgcaaaggtagttttttttatttaccctccaagagtttcgcgataaaaatcgaaacattcgtgcaacattttctccgttatctcacatggttctgccggtaagcctatccctttaagtggaataagcctgattttgctccccagattcttcttgtctttcatgcaaaaagccgtcagagacggatattgcttgcaggtgaaaaagaagggtgagtagtattctttggaccatgcgaccagcgagtagaggatctctcgagggaaaccatgtgccaccaccgaataatagagttcgcagataaggccgattatgactgcatggccatgcgaaaggcctacatttccaggcaaagtgtatgaaaagctttccatcgcatgcccgacggtatgacccagattgagcatgcttctaagtccggattcgtgcaagtcccgatttactatcgactccttgaaagttacgctatgccggacgatctcttcccatgcctccatattattaccgaacggatcgaaagaaataacttctttccattcatccgctcccatgagaagagcgtgctttaccaattcggcatgtcccgacagcagttcacggtcggttagggtggacaggaaagcacagtcacagaagaccgctttcggcagatggaaagtgcctatctcgtttttgacgccttcgaagtctatgcctgttttccctccgaccgaagcatctaccattcccattagggttgtgctgagatttaccgtccggatacctcgcttatagaccgaagcgacgaagccgcccaagtccgtaatcgtaccgcctcctatattcaataatagagagtggcgcgaagcacctctttcgctcagccatcgccataggggcaggcagtttccccactgtttgatcgtttcccctccggagagcaaataccaatcatccgcggccgttagtgctctgattgcagcaattcgctcggcatgcagcgttgccactgcctcgtcgcacaaaacaaacaatcggtcgcaagccatacccgacagtgcaggtaccagcttacgaccgataatatctgttccgacgatgaccacgggctatagggggatcagtccgttagctctgcttcggtcagtatctgctgaatggcagcaggcagtcctttaggattcttgcc

SEQ ID NO: 315 - DNA (genomic), 1673 bp, PORYPHYROMONAS GINGIVALIS; double-stranded, circular
  misc_feature 1...1673
  hypothetical: NO
  anti-sense: UNKNOWN
gtcttctgatatcatgactgatcagcgaaccggacaaagggctatacgatgctatgaataagggcctgcgtatggctttgggcgactatgtttggtttctgaatgccggcgaccttctgccatccgatgatcttgtcgaggcgatagccaacggcattaaaagctctccaatgggattaccggatgtcctttacggcgataccatgctgattgatgccaccggtaaggagaagggtttacgacggcttcgtcctcctttcgaactccaatggagaagttttgcggatggtatgttggtatgccatcaggcttttattgcaaagcgattgatagcaccgccgtacaacatgaaataccgattttcagctgatttcgattggtgtattcgtattcttcaagctgctcgcaatatcgtcaatacagaaatgattctggtgcactctttggatgataggggggggataacttacaaaaatcataaggcttctctcaaagagagatttttgatcatgaagcattactacgggagcaggaagtcgattatgaagcatctgagcttctttttccgccgcaagcgctaagctgttttgagaaaaagcaatctcaaacagaaagaatttcgtacttttgttttgcaaaaaggcctggtagcttagctgaatagagcgtcagattccggttctgaaggtcgcgggtttgaatcccgcccgggtcacaaagtcctacaaataacaatgcgggttgtgtcgaaattcgattttgacacagccccttttcattttgatactgggaataacgtcaaagcttcaactttcaaaagctgaggccgttgcagaataacccttccaccccatcatattgatcaagacaggatgagtttggcttctcttcgtctgcttttcctattggacttgacttcccccgacccaaaattcgaaaagctcatctcccaaatccggggatttctcgcctaccgacacaagcattgatttgacgaagaaaggaatgcttcatgcggatctctgcaaacctcaagtatacacctatgaaagaaactgggggaaatatctatttgctcggtgctcatgtcctggaggtttaacctttcacgaaggcacaaagaatcagctctgcggaaaaagagttcaatgaaaatcccctgcaacagtctcgattgagacattcgacagaaaagaccgtgcttcaacgccaatttgtacttttaccgtgcaatggaaaaactgatcgatattttggtcgtagacgatgatgtggcagtctgtgccgcactgcgtctggtgctcaagcgagcgggctataatcccgttatagccaacagtcccgacgaagctttgtccataatgcggaatcctgatggcggctgtaagccggctgtgattctgatggatatgaatttctccctttcgacctccggcagggaaggattggaactactggagaagatgcagatattcacttcctgccctgtcatactgatgacggcttgggcttcgattccactggcagtggagggaatgaggcttggagctttcgacttcataggcaagccatgggacaacgatcggctccttcgtaccatagatacggccttgcatctggctgctccctcagctgtggcgaatccatcggaacagtctgacagagatacagcc

SEQ ID NO: 316 - DNA (genomic), 745 bp, PORYPHYROMONAS GINGIVALIS; double-stranded, circular
  misc_feature 1...745
  hypothetical: NO
  anti-sense: UNKNOWN
aaagcgtaccgtttcagcaccgccgaaccacacggcaatctgccgacgcacatcgccctgctttacatccgccgttttcaaaacgttctccgcatgtgtctcgtgccgacttctccggtttccgctcggtatcaagccgtatttccgctccagctcatcgggtgatccgtttgctgcgtcttgcttcgaacttgtaaggcagctttttcccgtagctgtccacacgcagggagacgatatggatatgctcgcgcgcgatgtcgttgtgcttgaatacgatgtaaggctgtttgccgtatcccatcttttccatgtattcccgggcgatgtcctgtaactgctccgttgtcagcctgtcgtccggatgcggattgagggaacagtgaaacaccgtctttttcgtgcggatacccgacgggatgcgcatatccatatcggtcaatgctcgttcaaagttcgtttctccgtttgcatccacgctcatcgaggaggtcagaatgacggaggcgtttcccgccgttactttggaaaagttatatcccaacactttacccatgcttttcggagcggttatctcggcaaccatcgttcttcgaaagctactgtgagcccggttcgttcttccagaagcgcaaggagttctccggtgtattgctccagctttgcagcaaaacggccgccgttttgacggaatggtacgtgtaatggagcggacggcctgatgtagagcacgccaaccttgcgg

SEQ ID NO: 317 - DNA (genomic), 372 bp, PORYPHYROMONAS GINGIVALIS; double-stranded, circular
  misc_feature 1...372
  hypothetical: NO
  anti-sense: UNKNOWN
cggctcggggatattgacgaaataaagcactacaaaagcgagtgcaaaaatacacatggccaggatgatagcgggataagcctgcttgatattggcctgctgaacgttgctcccgataaagtaacccacgagcacgggtaccagagtcgccatcagcgaattgaaagagccacccacctggataagctggttaccgcggttgcctccgccacccaaggtattgagcatcggattgactaccgtattgagcatacacatggagaaaccggcaacaaatgcgccgaccaaataaatagagaagctacccatctcttcggacaagagctgtattcctatgcctacaaatccgacagcgatggcggataaaagctg

SEQ ID NO: 318 - DNA (genomic), 3365 bp, PORYPHYROMONAS GINGIVALIS; double-stranded, circular
  misc_feature 1...3365
  hypothetical: NO
  anti-sense: UNKNOWN
aaccaaatcggcacctgtttcttccgctttggctatagccatggcgagagctgcaggctcttcgggattgggagaatgtaccgtagggaagtctccgcttacaacatcctgttcgggtacgtgaatgatattggcaaaaccatattcacgtaaggcacggggtaccaccgtacttccggtaccgtggataggcgtgtatacgatcttcatatcccgatgacgggcaatgctttcgggagaaagactcagtgccttgacttcagcaatgaaagccgaatcgatattctcacctatcatccgaatcagctcgggcttggcttcgaatttgatctcatcaacggagcgaattctattgacctcggcaatgatattacgatcgtgtggagctataatctgtgccccgtcttcccaataagccttatagccgttgtattccttaggattgtgcgaagctgtaatcattacaccgctcttacatcccagatgacgaatggcgtaagatatttccggtgtgggacgaagttcctcaaacagataaaccccgatgccgttggccgagaatacagccgctgccgtatcggcaaaaaaacgactattgttccgacagtcgtagccgataacgacactgatatttgaagaaccggcaaactcgcgcaagagatagttggagagtccttgagtagctgcgcctaccgtatagcggttcatacgattggttccggctcccatgatgccgcgaagtccgcctgtaccaaactccaaatctcggtagaatgcatccacgagttcggtcgtatctgcattgtccagcatagcctgaacggcttttcgagaggagtcgtcatattctgttccgagccaaattcgagctttggcacgtacttgatccaataatttgtctgtttccataagtattttgtgtttctgcaatacgcacaaagataagttttccgcaccgttttccggttagaaataaaacagttaatcgaacaaagtcgaaagaatgtcgggcgtcttcaacagagggaaaggcggaaggtgaaagcgatagtagtccaccagataatccaaacctgtcttcgctcagctctcgaaagccgaaagctttcatattatcgaatgtaatacgactaaagagctgtaaatatgtcgattgatggggtggaattccccttccatgagcaggagcattcggtacgaagcgaccatcagcaggatcgaaccaacgcggaataacacttcctccgaactgtaaatcgggtatcaaccccaatggaacaagcaaacgaaaaagaaaagccagatgaaaattagccatcggcccgtccatttcttccaacttatctatggaaaaagccacaaaatcatacagattcgtatcggcttccggcagtcgtaagatcagataaagaaattctgccagaaagagtgctatactattccttaccggatcggactgaatacggccatgcaaactgcatagtttggcttctttgataaagtgcaaatcgcggtgctgcttgtgttcggccgtaatctccagttcgttcagaggagaaataagcaaacgcaagctaccgccacttttccctcgcttggatgaacgtggtatcagataggacactctgccactctctctactgaaaagatgggctatactataactatcgttataagccgtattgtggagaactattgctctgctgactataatcatgactaaccgaagatcgatacaaatatcgtctattcagtcgtctgaaacaatcgttttccacatagactgtcgataaacctgttgaaaattcgctgataaaaacttgtttattctcttgtccgatccgaaagaatcttcatataaaattattcttctgcaaagacaaaaaagttagcagcaaattctcatcaacttttgccaaggattactcacagctcggcacaaaaacaaacagaccgaattgaccgtagaaacaaaagttttccacattccgatggaaactcattggctatcagcattcaacgaagtgtataacctgttagtaagctatcagtatctattccaaatctgttaatcccctaccctattcaccgagtagttacaagccttatcaacagtttcaaccgacctccttcttcctatatattttttcttttcaaaaaggaatatataataaaaagaaaatcggttgcccacctgttgaaaggtgaagcaaccgatcgtgtcacagatatagaaaagtagctatgaattttatttgatcagtagccggattatcggttgtgggatcagaaattgatctttgtaccgacgaaaatccttctgggctgcataggaccgtatacgtaagtagaagctctacccggtcccttgtccgtgtctttctgatagctgttgaatatgttctgtattccggcattcaattccaaggtcatagtggaagcaaggtggaagtcgtggctcagcttgaggtctatatcggcgaaggccggagtcttgacgagcttggcatgaccttcggccaaacctttgaattgctgaccattcatttcaaagtcgaacgatccgtccggagctatgtgttctgcgggaatatcgccttcataggcttcgtgtactacatccattttgcccgtgaatgtaccggagagattgatggcgaagtgctcggtaggacgtaccgtagcaacgaaatagccgtacagattcggagtgcgtacatagtctttcacagagatctcggcttgtcccgttgttttgtccgcttccacagcggtatagatgcttccgtagcggcttctctgccatgtaccgccgagctggaggtcgaacgatttgttgtaggcgattcttccctccagattcacaccatataccttcgatactccatccttgtcgttgtagatggtacgaatgatccattctttgccatcgctcgtggtttcgaccttatcggatggtttgaactgattgctgataaaggtggagaaggcttctcccatgatattgaattgccattcgtcggctctgtggtaataatcgaaagaagcactgatgcttcgtgaacgttcttctttcagattgggggaaaggacacggctgataggagtaccaccggccaactctacgtgcagatcttcatcgaaatactgaggagcgcggaatccttcgctgtatgagagtcggaagctgagattcttattgggattgtatcgtacgttggctctaggactgaaaatgaagagcggatcgatatagcgtttgccatcctgattgaggagaacatagtcgatacgtgctccgataagggcacttaacttctccgtcttatattcgagctggtcgtactgactaaaagtagaggtat

SEQ ID NO: 319 - DNA (genomic), 745 bp, PORYPHYROMONAS GINGIVALIS; double-stranded, circular
  misc_feature 1...745
  hypothetical: NO
  anti-sense: UNKNOWN
cgcacaanttttcagcttaaatgtttctttcagatagatgatctcgccgttggtcaagagatgatcaggccccaaactggaacccgaaagtgtatagatgcggaccttaccgttagtgacggtaggagtaagatcggcataggtgccggaagcacccagtttagcctgaagcgtcatcgcccccacccctgtgaggtaggcttcatcgggatactctatcgaaagataaactgtctgggtcgggttctgagaaccattggttatagaaaactctcgtacgatggtctccccaatctgcttgttcacttgcggcgcaggctgtttgatcgtcaggttcggatagtttaccgaataggagtttgattccttgctatcactatgatcgccgatagtcaccgttaccttgtctttgaagacaaaacccgtttcggcagcattaatggcattgctccatgcggtacagacagctctcctcttaatcgtcagcttaacgatggttccaagctctaccacattgtttccatccgccgattttaccgtaaatacaggttcgttcggattagaaacattggtttccgccaccgtcactgcattgccctgtgtaacacttacgacagccgttccgaccacatactcgacaccgncggcaagtttcacattaactttgataccattcgaatcctnctggactacagtnaagtcaatgatcaatggctcttctncagaacatacagcaatggacnaa

SEQ ID NO: 320 - DNA (genomic), 784 bp, PORYPHYROMONAS GINGIVALIS; double-stranded, circular
  misc_feature 1...784
  hypothetical: NO
  anti-sense: UNKNOWN
atccccggccgtacacggctctaatccggtacccccttatgcctatgtagcctcatatctgtggacacagaaagcattcaaagcggatgtgatgatgcacttcggcacgcatggcagccttgagtttatcccgggcaagcagatcgcactctcttctgaggattggacagaccgcctcgtcaatgacctgcctcatatctactactataccatcgccaatatcggtgaaggaatgatcgccaagcgcagaagctatgccggtacggtatcttatctggctcctcctttcatcgaaacgcgcatgaggggtcaagtaagcgagttcctcagcttgacggataaatacctggagcaggacaacgatgataaagccctgtctctccgcatcaaggctttggccgtgaagaacggctaccatcgggatctgaaactcgactccatccttgacaaaccttatacacgtgagcaaatcatctctctttccgactttgccgaagaacttgctgtcagcaagatcccgggtggtatgtacaagacaggcgttatgttcccggaagaaaagatccgctcttccgtgaagcatattgctacagatcctattgcttatgctttggccgctatcgaccgtcagcgtggacgctacacacaggagcagcaagatagcgaacgattctttaccaaccactatcgtcgtcctgccgaagcactggtagagcgttaccttggacgcnaggcggtagatgtgaatgcagcattgactacgctgggtgtactgtccagcgaa

SEQ ID NO: 321 - DNA (genomic), 617 bp, PORYPHYROMONAS GINGIVALIS; double-stranded, circular
  misc_feature 1...617
  hypothetical: NO
  anti-sense: UNKNOWN
ggatccccgggattggttcttcctcttcttccggtggagacacggcgccttccgagacactgaggttggcgaaagagaaagccttggatcggcttttggtatagaagcagtcgatgccgaggccacccgattggaaaggggattcgacatcgaaagaggagcttccgatgaggacagtctcgttgccggtatcattggccccattgacccaaagctgccaaccgctgccaactgcgtatgtgaccgtaaagctcgtgaatggctttgttcccagcgggtatgcgctaccatcgatgagaatatcggatcggacgatgctgctctcgcctgaagggagaacgcggagtcggacatccagcagatccacccctttcgagccgctaccccagcgaagagctacatagtcgaactcggagtcgctgatctctccataacagtacaggtagcaatagagatagttgttgatggtcgggcggaagtccagcttgacatcgcctttccatgttgtagtcttgaagtacgggacggtgatagctatgcgcgattcgttcaagtcgtcgggatattccacgtagagcttgagttgttttttgatgatggcaaagtctgcatctgtc

SEQ ID NO: 322 - DNA (genomic), 482 bp, PORYPHYROMONAS GINGIVALIS; double-stranded, circular
  misc_feature 1...482
  hypothetical: NO
  anti-sense: UNKNOWN
attctgaacaagaaaggtacatttgccggctttgaagacacatacaagcgcatgttcatgaactacgagccagggcgttacacaccggtagaggaaaaacaaaatggtcgtatgatcgtcatcgtagccaaaaagtatgagggagatattaaagatttcgttgattggaaaaaccaacgcggtctccgtaccgaggtgaaagtggcagaagatattgcttctcccgttacagctaatgctattcagcaattcgttaagcaagaatacgagaaagaaggtaatgatttgacctatgttcttttgattggcgatcacaaagatattcctgccncaattactccggggatcggatccgaccaggtatatggacaaatantangtaatgaccactacaacgaagtcttcatcggtcgtttctcatgtnagagctnagaggatctganaacncaaatcgatcggactattcactatgagcgcaatat

SEQ ID NO: 323 - DNA (genomic), 774 bp, PORYPHYROMONAS GINGIVALIS; double-stranded, circular
  misc_feature 1...774
  hypothetical: NO
  anti-sense: UNKNOWN
ctntagaggatccccgggaaaaagattcgctttaagcggaaaatgctttccgacttttcgcattttgtaaacaaattcttcttcttgccaacgactgatacacaaggaggacttaaggggttctcctcaacgggacgttttattttcctccaaacacggatagatagtttcctgttcgataccgagtttatctgtctggctaagagaaaaaaagtgtgcatagcagtcgtcagcggctccattcgtcctgacatctctctgtcggtaatgaaagccaagactatccttcgtgaagtctataaaatccccaaattgatcaaagcaagatggttctcttgagtttcgatatcgaggagttcgatgtaccccttgagcagggatataaggacttcccatcggaagaacaattgcgcatcagtcgtcaagggacagaagccatcctccatatattgagaaaaaaaggcgttcggtccaccttcttcagtaccgttactttctgggaatcattgccggaggatctgcgaaagggcatttacacggatggacacgaattggcctctcatggtgtgtttcactcttctttctccaaagagcaccttgccgaatctcgtcagaagctcgcttctctgtgggatggtaccgatgtctgcggttttcggatgccacgtatgatgcccgttggcgatgcggaaatagccgaagccggttacttgtacaattcttcgctcaatccgacttgtatccccggtcgctacaatcatctctcggctcggg

SEQ ID NO: 324 - DNA (genomic), 470 bp, PORYPHYROMONAS GINGIVALIS; double-stranded, circular
  misc_feature 1...470
  hypothetical: NO
  anti-sense: UNKNOWN
taaccggccgagcgaaaccctcgtgcccggtggtcgcgatcgagctgaagcgatgtataggtcatattggatcttgtggccgaacagtggatgactatatatttgatggtattcattgttttggatgttgatagatgaaaaaattaaacccattatagaaagacaaaggccggagacaaaagcaaatttccttgtctccggccttccgattagattcccgtccctgctcgaatacaggaggaatacggatcagaattagagaccgccgcctccgctgccttgctcaccgccgccctcgggagaatcaggaacagagggagtaccaccttgctgttctccgggacgaagcatattgatccctttcagacgaatttgccgacaggcgcggcgaatatccccaccgggcagaaagagcacccgtgctcggcggatattttccacggtaaatcctctccttctttggcggcttt

SEQ ID NO: 325 - DNA (genomic), 510 bp, PORYPHYROMONAS GINGIVALIS; double-stranded, circular
  misc_feature 1...510
  hypothetical: NO
  anti-sense: UNKNOWN
gggattgaggacttcatattggcctttaagagggaaaagatatgttgccggcggtaacgtcgttggacgtctcaaaggggcactcattaaaggggagtaaatttccaccggtggaaaaccggtgtgtaccaaatagtcgcctgacacagaaataaaaagaatgaacaaaagtgcctgcttattgtgcaaaggtcccgaataatagaagaaagaggctaaggatacagtataaagatacagtataaattttcaaatgaaataaccctggggttacatcagatttgagtagggagatattgatatggttagtcggggagaacaagctttcgtttcgctgtgatcatatctattttaatgcgatagatagcggtatgtggcatgccgctttcaacggccttatcgaacaaatccattttctctggcgtgtacttctcgcatatcaatcgtaaggcatgcacgcactcctcatgatctgctacacgaatgacttgccccttgactattagcact

SEQ ID NO: 326 - DNA (genomic), 1654 bp, PORYPHYROMONAS GINGIVALIS; double-stranded, circular
  misc_feature 1...1654
  hypothetical: NO
  anti-sense: UNKNOWN
tcatttccctttcggttggaggacatccaagaggcatatcgacatcatggccatgttcaagatcaatcgtttccattggcacctgacagaggatcaggcatggcgtatcgaaatcaagaaatacccacgactgaccgaagtggggtctacaaggacggaaggggacggtacgcagtactccggtttctacacgcaggagcaagtacgggatattgtacaatacgcatcggatcgtttcattacggtgattcccgagatcgaaatgcccggacatgccatggctgccctcgctgcttatccgcagttggcttgcttcccacgcgaattcaagccncggattatctggggagtggagcaggatgtttattgtgccggtaaggacagcgtcttccgttttatctctgatgttatcgacgaggtagcaccccttttccccggcacatacttccatatcggaggggacgaatgccctaaagatcgatggaaggcttgttcgctttgtcagaagcgtatgcgtgacaatgggttgaaagacgaacacgagctgcagagttatttcatcaaacaagctgaaaaggtcttacaaaagcacggcaagagactgatcggttgggatgaaatcctcgaaggcgggcttgcaccttctgccaccgttatgagctggcgtggagaggatggtggcatcgcagcggctaatatgaatcacgatgtgatcatgactccgggtagcggaggtctctacttggatcattatcagggagatccgaccgtcgagcctgttgccatcggaggttatgctccattggagcaagtgtatgcttacaatcctttgccgaaagaattgccggccgataagcatcgctacgtgctcggagcacaggccaatctgtgggcagaatacctctatacttccgaacgatacgactatcaggcctatccaaggctactggctgtggcagagcttacctggacaccgttggccaagaaagattttgccgatttctgtcgccgtttggataatgcctgcgttcgtctggacatgcatggtatcaattaccacattccgctgcccgaacaaccgggtggctcttccgactttatagcctttacggacaaggctaagctgaccttcacgacatcgcgtccgatgaaaatggtctatacgctggacgaaaccgaaccgaccctcacatcgactccttacacggtccctcttgaatttgcacaaacgggccttctgaagattcgtaccgtcacggccggtgggaagatgagtcccgtacgccgcattcgtgtggagaaacaacccttcaatatgtcaatggaagtaccggcaccgaaacccggactgaccattcgtacggcttacggtgacttatatgatgtgcctgatctgcagcaggtagcctcatgggaagtagggaccgttagctctttggaggaaatcatgcacgggaaagagaagataacttctcctgaagtactggagcgcagagttgtagaggctaccggttatgtgcttattccggaggatggggtatatgagttctctacggaaaacaacgagttttggattgataatgtgaagctgatcgacaatgtgggcgaagttaagaaattctcccgtctgcaatagcagtcgttccccttcaga

SEQ ID NO: 327 - DNA (genomic), 554 bp, PORYPHYROMONAS GINGIVALIS; double-stranded, circular
  misc_feature 1...554
  hypothetical: NO
  anti-sense: UNKNOWN
ccgacaatcgtaccttcaaggccaaactgatcggtagcgatgccacgaccgacatagccttgctgaaagtagatgccaaggggctgccgacaattcctttcggcgactctgacaagcttcgtgtgggagagtgggtattggccgtaggcaatccttttaatcttacttccacggtaacggccggcatcgtcagcgcaaaaggtcgctccactcatcaggtggccagaggcggttcgctccagatagaatcttttattcagacggatgctgccgtcaattcaggcaacagcggcggtgcgttggtgaatgatcgtggcgaactgatcggtatcaatacgatgatctacagccaaacgggcaactatgccggctactcatttgccgnacctatttccatagcggcgaaagtggtagccgacatcaagcagtacggaaccgtacagcgcgccgtgctgggcattgccggcggagatatatcggacgaagcacgtcaaagaatacgatctgaagtgcgcaagggtgctctcgtagcagactttgccgaagtcagtgca

SEQ ID NO: 328 - DNA (genomic), 803 bp, PORYPHYROMONAS GINGIVALIS; double-stranded, circular
  misc_feature 1...803
  hypothetical: NO
  anti-sense: UNKNOWN
ggatgatacgatcgccggccgcccatccctttatcccggccagtacaattatcaagagaaaaattttcagtcttttcattgctctaaattctttattatcattagttgtgtataacaaagaacctatatgaatctgaaaagaatctgaaatgacaaaagattttgaaaaaattttttccgaccggctgatcgagcactttcttatgcttccttgccgatggaaaaagtgtgtttcccattctcgaagcgataagtcagtcggagtccgtacagctggcatatagagcgtgcaatgggaagccccaagccggaagaatgagcctgtttcatatcgtgatagaaacgttcgaatatcaaggtctcgtccaaagcgttcttcacccccgtattcgctatgctgcaatgcatagaggtaagatcgatatggatctctccatctctttcaagaattgtgcaagagtatgccgttcttaagcaggttgcttagcaagactttggccaaagtcgggttcattgatagaaccattggttcacttctgctccatacaatgcgaatacgtcgattggcgaaaatcgcttcatactcctccgccaaattatgcaatagctcattcacatctatgctttcctcctcagggaattgatggttttcgattttgctatagaggaggagggttttattgagctgtacaatatggttgatggactgtatagccttataaatctgttcgagctgctgtcattcaaaggagggatcttgcagtagcatttccagtttattgcggcttatggccagaggtgtt

SEQ ID NO: 329 - DNA (genomic), 4137 bp, PORYPHYROMONAS GINGIVALIS; double-stranded, circular
  misc_feature 1...4137
  hypothetical: NO
  anti-sense: UNKNOWN
cggctgattgcgtacttcgccgaattcgtcttggccggtcatgatcggacaaatggcttggatcttaatgtccacatcgctattggtcggagtgaagtaccattcttcctttacgtagtaggctttgacttctgccgaggggatgtcgctatctgccaccttgaagagctccgcattcttgttcgtactcggttggtaatagatgccaaacctgtccagaaactcttggaacttgatcttgtactggtctgtgaaggcttcgaatccatccagatattcgtacacgtcgaggctgttggaattgatgagtccgaatatcgtgctgaagagattcttgcgatcaccaatcggccggggaggataatagagtaccgcattggactcttccatcaggtctacgcgtcggtacacgactcgcctccagggggcgttgtcggtcttctgtgtcagacgtctgttgaattcctgagcacgattggatagagtagtcgtttgttccacctcggtattgcgcggtgctcgacccacttgcggagagcggttgttcgtattttcctgcgcaacggacgagatactgaccgtcgctgcaaggatcgctcctatgactgctttgaatactttcataaacactattagttcacaattacttcaatggccggaatcttacgttcgataccatccggaccgcgtgcaattacttctgttacgtagaaacgcttgcctttgcccagattctgtatttgtcgtttttgtctctcagagaatgaagctccgtcggaaacttcgggaatcgagttgcccatcgaatcatagaatacgagttggaacttcaccactgtgtagtttacttccagcaaatcatcgtcaagagcggctttaatgccgcctgctgccaggatttcacgcttacccaaacggccacccttgaagcgtttcgtgttcccctgcacatccttatattcgatatagggaagaggatcggggagagctctgacacgtaaggtagtctttgccatttggatggtacggcctcctgattgagctgtgacggaaataatggcttcgctgcctactttcgtcggccgtgctatccagagattgccacggcgagtgagcgtaccattgttgatcgttgcagaaacgttttgctgagccacacccggtacggcgatattgatcggattgtctataccggcatagagtacgttcatcatcgtcggagcaacggaggccattggttccgtaacgaagtattcgctttcaaagtcacggcgaatcttaaccccatcgttacccatcatttcgatatatcctttgaccggatatgtgcccggtgcacctgccgtagccgtaaataggcccatgttctcgggagaaaggagcttaccgtttacaaatacgtccggtctttgcgtggtatctacactggagaggacgatattggccttatatgtatcgcccgacatgacgatttggctctgtggaatcacttgtgccgtgatactgttcacacgataatcccccacatccacgctctttaccagatcggcaagtacttcgccctgagcataacgcacatcgctttggagcttggtcaggagtgtaatggctgctacagtaggcatattctcgaacaaagaactttcccaagatttgcctttggtgccggattctgtgttaagggcttgttctatgagtttcaacttcgccttgtcggtcatgagtgtagcgaccagctcgcggaacttgtccacctccttgcgaagtgtgctgcctttaccgttgatcggattcagcattattacggaagaagcatcgagattgtcctttcgtctgatatcattgacttttgcatctttcccatccgactcacgggcaatggccaacttcagatcatctataaaggtacagagcgaatctgcctctttctgtaagacaaggctacgctcataccatactttcaccttttcgggattggtgcgataagccgtattcagctcggacagcaccagattgttgcgcttatcggagccgtcgatggaagaggctaagctcttatccactttgtcgaaaccatccagtacctcactcgatacgttcaaagccatcatggcgatgaacacgaggtacatcaggttgatcatcttttgcctattggcattcccattagaacctactgccatggcttataagggtgagctgccggatgatgaaggattagaagcaccaaaattgccgggcataccgggtagacctacattcgttgtcaaggcttggagcaagcgagcatacacctcgttgagttgtgtcagttggcgtgccatacgctcgttttcgttgcggaatgaagaactgtcgatgacactattgtcatacatatctcggatatgagccaatccgcggttgatgcgatcgatggtgtcgatctgggagctgatgcccttgagctgtatttcgtatatggtattcaggccggagatattgcgactgaggctttccatctgctggatatacgattgcgaattgagacgcaggccttcctgatccgcttgcatctgctcgtagctctccgtcatggcggctgcagtccggccgatacgggcaagctgttcgcctgcttcagccagtttgtctatgccttcgctcaggcgttggatctgctcttccggcagtattccggtcagttgggactggaaaggagtggcaggcttgggctgttcttgcggttgcgtacccaaagaggcagaggcaaggcgcacagaagatggtctttccgcgtatgcagctgcttctttggccttttcacgaagatactcccgacgctgctccatctcccgacggtccatcggattcttcgagtccagttcggggaagacctcttcccagtgatattccattgcgggtttttcaaatccggagataaaaaacaccaagaattctgtgatcatccccacgaaaagcatctcattgcccatcggcaaatggagcaacttgaagagagcgcccaaaatcaccactgcagcaccccaactataaacgatattgagaagtcggcgtcctttgtgactggccaaatacatctcaaggatgttcttgtatcttctataatgacccataatacttgtttttcttgttttgaatatagattggcgatacttatttctttgtgctgcgacgcgaactcttaggagcctttccggaagagaaggcaatggaagtacgtacacaacggaatccgatataggaacgacctacgttctggtattcatggctacgagtagccgagcggatgaagcgggccacatctttccacgaaccaccgcgtactaccttttgcttcaggatgtacggatccgtgagcgcagctttgtattccagttcgggattgatgtccgacatttgtttgagtccggactccgaaaatgccgtgctggtccattcggccacattgcccgccatatcgtacaagccgaagtcattgggcgaaaaactggatacgcgggacggtatcaaatgaccgtcagccgtataatctccctccccgggcttgaagttgcccaagaaacaaccccgtcctgtcctcaagtcttcggtactccagggatatttattgttggaatcgcccattcgggcagcatattcccattcggcttcagtgggcagacggaagtcgtccatgatctgtccttcaggcaagcgaatacctttgcggaagaattccgaccgccacgcacagaacgcctgagcctgttcccatgaaatacctactacgggataatcatcgtagcccgggtgattgaaatacattctcgtataaatctcggtacgagcattggggaaatcatttacccagcaggtctcatcgggatagatcggtacgatgtatgtgttgagaaaatcgtattcgctgctaagcggacgcgtaatggtttcgctgatgatattgccgctttcgtctacgaaagccgtgtctttcgatatcatcactacggcgttggggtctaccttgatgtccgtattcagattgcgctttgcggccttgagctgatgctcgcgcaaagctgccgaacgataatcgtagacttcgtaccgatagaccatttgatccggattgagctttcgatcatgagtgaccgg

SEQ ID NO: 330 - DNA (genomic), 843 bp, PORYPHYROMONAS GINGIVALIS; double-stranded, circular
  misc_feature 1...843
  hypothetical: NO
  anti-sense: UNKNOWN
ccctggacaggtaccacacatgcggagttcatagaagccttgggacgtttgcgcaagaaaggggctacgagccttatcctcgatctgcgagaaaatcggggcggtttgctggagccggctattgccatggccaatgaatttttgggtaagaatctccccattcttcagatcgaaggcaaagcgtatccgcgtgaggagatttcgtccgatgggcaaaaggtatcttgcagcaaattcctctggtagtgctggtggatgagttctcggcaagcagcagcgaggtatttaccggtgccatgcaagaccatgaccgcgctcaaatcatcggtcgccggacgttcggcaagggactggtgcaactgccgttcgatttggcagatggttctgccatccgcctgaccgtagcacgctattatacgccatcgggacgctccattcagaagccgtattcttccggcgtagatgaaaattactatcaggatctgaggaatcgcttcaatcacggagagctatactcggccgacagcataccttcactgggaggaaagatattcaagacagccggtggccgcgaagtctatggtggcggtggcatcataccggatatttttatcccactggatacagccggtcttaattcctatatgatgaaagtggaggattcggatttgatccctcgctatgctttcctgtacagcgatgcgaacagggtttccttgagtcgttttaagacagtcgaggagttgggagcttatctggatcgtacttatctgattttcgactttgcttcttttgccagcgtaccggatcccgatgccgtactttttttaatcaacgaagctt

SEQ ID NO: 331 - DNA (genomic), 935 bp, PORYPHYROMONAS GINGIVALIS; double-stranded, circular
  misc_feature 1...935
  hypothetical: NO
  anti-sense: UNKNOWN
ccaggattggcaaaggcattgcgccaaaggatgaagcgctggggatcatttgataatcacatatcccgtagccccgggctgatcgcgcaaatatacatcggcaagagcaacgacttcgcggacaattacatcagaaggaagaccgaccatcacaccatgtccttcatatgccaaatcgtacacatgcctacgcatttcttccggcatatcggccgtgtattcattatcgacacgcttatcaggattggtctcacgtaaataatcttgccactccatcctgcgacaatgctcctgggtcagatcaaatacatcttcataacaacggaatgaagcagctatatccttggcctcatcacaaatctgcggtaagaagctgtagttctcaggaggcaaagtgcccgattcatcgaaaaagcgagcacgcaaggcctcgaagcgtgccgtctcttctcgtccaacacgcatcttgatgctccgtccgcctttatagcttacatagatggagctatactcaggcgtatagtcaaattcgccccaaggataaccgggtacctgatcttgaagaaagagtgttactgcctcgatatgcttgcatgttccaagcccattcgttctaaaatcgagacaagaacaataattccgttcgctccgaacaccacggaatgcaactcggtatcggttgcggccgtttgcgaccaaataatcgccccatatccgattctcatccaaatgttcaacatcgaaaggattctgttcagcaaattctcttcttaatcctacttgccactcttctacggtcatgccttccggacaaaaccgattagacaatttctgttctttcattgaataaaccttcttttactttacattatatattgtctgcagaattcatgtgtacagtatcaatccggcctttttcgagttcggctttcaca

SEQ ID NO: 332 - DNA (genomic), 1912 bp, PORYPHYROMONAS GINGIVALIS; double-stranded, circular
  misc_feature 1...1912
  hypothetical: NO
  anti-sense: UNKNOWN
tttgagtcttccaaaaagatgttgtagaaagatttaccatagcgcgaaaaagttattttagtttccacttgagtggatttacctttcatactttattcatcctttttaataaaaatcatctgtaagaatattactatgcaatggcaagaactttaccgtcagcgcgtttgctctgcagacgaagctgtcgtggactctcttaaaccgggaacgaaagttgtattcggtcatgctgctgctgcgcctgtccgtttctctcaggctatgtaccgccagcgtgaaaagttggagaatatcacagttttccacatgttgtatttcggcgacgcgccgcaccttgctcccgaaatgcgttcgcatgtacacccgactctcaacttccttgagggcaactcccgtccggcaagccgtgaccgtcgtgtcgatttcattccctgccacttccacgaggtaccggaactgtttcgtcagggattctttccattggatgtagccgtagtgcaggtatctactcctaacgaagagggttattgctctttcggagtttcctgcgactacacaaaggctgccgccgagtgcgctccggtagtagtagccgaggtgaacaagcaaatgccattcatcggtggtgaaaacctgattcacatctccaaactgacccatatcatcgaagtggacgagccgattgcagaagtattgcctcctgctatcagcgaccttgaactgaggataggtcagaattgtgcctcactgatcaaagacggcgataccctccagttgggtatcggcggtatccccgacgctgtgttgcgtgcattggaagggcataaagatctcggtattcacacggaaatgtttaccgacggggtgatgcgtatgattcgcaaggggattatcaacgggaagaaaaaaacattgcatcccgaaaaagtcgttacctcgctaatcttcggatcgaaagaattgtacgattttgtcaataacaatccggtgatagaatgctatccggtggattatatcaacaaccccgatgttatcggtaagaatgaccgcatggtttctatcaattcctgcttggagatggatctcatggggcaggcagcttctgagtcgatcgggtacgaacagttcagtggatccggaggtcaagtcgatttccttcgtggggccaagcgttccaagggaggaatctccattatggctttccccagtacggccaagaaagggactgagagtcgcatcgttcccattctgaaagagggtgcttgtgtcacgaccggccgtaacgaagtggactatgtggtgacggaatatggcgtagcgcgtctgcgtggcgcaacgcttcgtcagcgtgctgaagccttgactgctatagcacatcccgatttccgaccggcccttgaggaggaaatccgccgacgcttcgaataagtcggaaggattttaggccttatataaacggattcgaagccatgtacaactacattgtgtacatggcttcgtatgtttaacgtgagttcaatgtaagcgatatggtgccgattctctcttgatgggatattgactataaccgaatcagaaaatgaaagggaaaaagtttgacgtctcatcggacgtcggagcctctcgaagctgaaacctctcaacagacaaatgaaatacattgacaaacagcatattgcatgtttttcttggatcgaatccgcattgttttatagccgttcggaacatacgccgaaagggggtcgagctacgccctacagcgactcgggctacgccgtagagcgtaccgagctgcgctctacggctcttcgagctacgctgtagagcgtacctcgccgagctctacagcgtagctcgaagagccgtacgggatagctcgtcatcctctatggtgtaccgccatcttgcc

SEQ ID NO: 333 - DNA (genomic), 906 bp, PORYPHYROMONAS GINGIVALIS; double-stranded, circular
  misc_feature 1...906
  hypothetical: NO
  anti-sense: UNKNOWN
actctagaggatccccggcagtcgtatacgacatgcagggccgaatcgtggagaaagtttcattttcagggaaagaatataagctgaatgtgcagtatctgtccaaaggtacgtacatgctgaaagttgtagcggatacggagtatttcgtggaaaaaatcattgtagagtaagaaatcggcacgaaaaatctaagaacggaaaaagacacctgagtcttggagtgggaatgcttgtcggaagagaatcgcccgacttctttcccgctttgaggcgatgaacagcgaactctcccgtccgatctgcgggagggtttaagacccccttatacacaagggtctctaataaactgtgaccggatccatgagagggagagtcgtcctgacaaaccctcttgtggatctttctttttttctatcggcttgaatggtggcaaaacgcaccggctcgacattcaggatgttccggcgtcggggatagctcaaggtcggtttgcgctccaaaattttcgtgtttgtgacctctaaaaacgtggtgcgtaaactgtttcgttttggcgtgggaagtgaaaaatttacgcaccacgacgaaaaaaatctcgttccgttttctcggaaaacacagaccgcaatcggcagatttttggctcgaggttggccggagatcggatcaccgaagcgaggctgatgcatcggtatatatgagccaagggatgtatctgtaggaattgacgtacttttgtccggaaccaagtccgttttagagtatgcgctttgatgaattgaatttaggagatgaagtattggatggtctcgatgccatgaatttcatcgagaccacacctgtgcagctgcaaccatccacccattctggaggtcgcgatgtgatcgcttgtgccagacgcac

SEQ ID NO: 334 - DNA (genomic), 494 bp, PORYPHYROMONAS GINGIVALIS; double-stranded, circular
  misc_feature 1...494
  hypothetical: NO
  anti-sense: UNKNOWN
atccccgaaactcttcttgcgacaggcttactgttttcagttgacttncaaatcttttacattcgaggaaacgtattttgtctgccaactccttacgagcttcttctgtcagttcaaaagcattccaaagcatttttacttctttctccaaatactttcttgccatctctgggaaatagcaaacctccaaaagatgaaggtattcttcgaattgggacaaatttccttgctcaatatctatgggctgtatctcttttgaatgtatgttttgcaagagatgccttaactcttgactgggagttgtttcgttcaggctatctgtcattattcgggaaaaaggaatagaagagcaatgaaaggcctgtactgcagattctttatcattgttcaagaaggtgtatcattcctaagtagtaataatctataggagccggctctttttgagtcgatactttgtctatggcatctgtgataatggttcttttgaccaagat

SEQ ID NO: 335 - DNA (genomic), 3436 bp, PORYPHYROMONAS GINGIVALIS; double-stranded, circular
  misc_feature 1...3436
  hypothetical: NO
  anti-sense: UNKNOWN
ggctggtacccgatagaactggctgatggcaaggaaggctggcttcctgctaccgtcctcactcgtattcatgtctctcccgcagactgatatttacctctcttgcatatatgtttttggaatacattcttgaagtagaaaggaacctctttttgactctgaacggagtacagcatcctttgttggacggttttttctatttgatctcggccaaatggacttgggtgataatgtccatcgcgtttctgttcttccttttttataagaaaccgacaaaggaagctctcttcatcgtaggagcagtcttattgagcgtactcatctgcgatcaactctcctcttcttttttcaagcctttcttcgcaagattccgcccttcgcaccaccctgattttatcgactatgtgaagacggtctacggctatcggggaggaaagtacggatttatctcagggcatacgacgaactacatatcgctggcattatttacgagccgtatttttcggaataaattctacacgtggacgatctggagcgtcgtcgcactcgtcatctatagccgtatttatatcggagtgcatttcatcaccgatattatcccgggtatcgccgtcggacttatcgtaggacactttgtttataaagtctatctgtatgcacgttcccgttggttgggagcctcatgccctgcccatccgtcggcagtctatgccggcgattccattcggctttggacacttagcctcatcggctttgtctttgccatgctgtgtatgtcccgccagttgacggagatactacagtactatgtcttcctgctcttctgaggaaattcctcggtatcaatcttcgaggaggagctgtagttcgtccgtggtgatatcctgatgaatctccccacggtaggcgaacgaaatccgccctctctcttcgctgataataatgatcttggcatccgtctcctgcgagagacccagagcagatcggtggcgcaatcccaaatccttgttcagatccgtattgtatgcgaccggcaggatacagccggctgcaatgatgctattgtccgcaatcaccatggcaccgtcgtgcagcggactgtttttgaagaaaatgttttcgaccagacgggcatttacttcggcgcggaacacttcgcccgtatgggcaaacggagtgaggtctattccctgctggatggcgatgagagcgccggtcttcttgcgagccatgttcatacaggcaagcatgagcggagctatgatacggcgttcgtcctgcaaatcctgttcgcgcttttccttattgagaagacgcttgagcgaacgccatcggcgcgtagagcctatcgccgtgagcatcttgcgcagctctccctgaaaaagaatgaccagtacgaagaaccccaagctgacgaactgattgaggatggctcccatcagacgcagctggaatatctgcgatacgatgatccaaatgacgaagaaggtgagaatccccgagaaaagagccttgctgcccgagtgcttgaaagtggtataaacggcatagatgaataaagccacgagcaggatgtctattacatccttgatggtaaactggagaaacatgagattgagatgtttttttgtggagtgagaatttctgtttccgatagagaggcgttgcccttacttgacgacgccgagtttgtcggctatacggcatacttccaccgcttcccgcacatcgtgcacccgaagaatgtccgccccatgcatgacactgtacatattcagtgccgtggtaccgttgagagcctcctccggagtggtgccgaatagtttgtagatcatactcttgcgcgagatcccgaccaggatgggaagctccagctcgccgaaagcctcctcctgccgcgatagcaattcgtaattctgctccagcgtcttgctgaaaccataacccggatcgaggataatgtcgtgcagacccaatccgcgcagctctccgacacgctccacgaagtaatccagtatatctaccgcaatgtcttcgtagtcggtgaggctctgcatcgtagccggtgtgccgcgcatgtgcatcaggatatagggcacttgcaaagccgccaccgtgcggaacatatcgccgtcgagctgtccgccggaaatatcgttgacgatgggctaccccgtactcttctacgcacatcttcgccacatcggcacggaaggtatccaccgataccggcatgtccgaaaactcatcccgcaatactttcagtgccgggcgcagtcgctccatttcctcctgtgccgatatgtgatccgcattaggacgtgaggaataagcaccgacgtcgatcaaggcccctccttcttcgacgatttcgcgtgcccgactccgcacactgtccacgctcgagaggcggctgccggagtaaaaagaatcgggggtgatattcataatgcccattacgacgggcttttccaggctgaaaagcctgccgccgaggttgagagtcttccgtttcatctgcttgatgctttcttttgacacccccaaaaatagccaattcgatccataccgaggtcgtaagatattcacacccattggatgcacattccggtctcgagtgcaacgtgaccgattgggttttatagccggatacggcagtgtaggggtgcagaagttctgttcgactttttaggttccggaattttctcgttttacagtcagcaaaacgtggttcgagaaaatttttgttttggcgtggaaaaaataatttatcgaaccaaaacgaaaaaaattacgcgcgagttttcccgttttcaggaacggcaatttcatcatttttggttccaaaatcgggaggcactcctatcgaatcaccttaaaagagcctcgatattgcccatgaagtgtaaagaatccttggcagataaatattcagttggattaaactccatgtgaaagcagatttaattctctgtatttttttgttggtttttatctaaagtttatgtgtacatttgtttttcaaaacttcaaaaatcaattcgtatggattttaaagacatcttgaggcaactttcagagagaatcgaaaaacttagagacaatttgcaaacagaggaggcaacgaagaatgcacttatcatgccatttattcaggcgatgggatatgacgtgtttaatccgttggaagttattccggaatttacttgcgatataggcacaaaaaagggagagaagattgattatgcaattatgcgtgataatgaacccatcattttgattgagtgcaaacattggcgcgatacccttactcttgccgataatcaactattaaggtactttcatgtttcgtctgcaaaattcgggatgctaactaacggtatcatctatcgcttctatacagacttggatcaagctaataaaatggatgaaaacc

SEQ ID NO: 336 - DNA (genomic), 652 bp, PORYPHYROMONAS GINGIVALIS; double-stranded, circular
  misc_feature 1...652
  hypothetical: NO
  anti-sense: UNKNOWN
tcagatagcgccattttccacggggcagattcttcttggtcagtccggcaaaataaacgcgatccagtttgacaacacgatagccaaggtgttcaaacaaacggcgcacaatacgatttcgtccgctatgaatctctattcccacctgcgaaagatcgtcttcttttacgtaactgatggcatcggcatgtatctcaccatcatccaattccacgccgtcggctattttctgcatgtcttcaatgcttacatctttattgagccacacgtggtagatcttcttcttcttgaaagacggatgggtcagcttagaggcaagatcgccatcatttgtaatcagaagtacaccggtagtattccgatccaaacgtcctaccggatatattctctcaggacaggcatatcgtactatatccattactgtggtacggcattcggggtcatcagaagtggtcacacaatttttaggcttattgagcagtacataaactttactctctatttccactctcttatccttgtagattacctcatcctgacgtgtaaattcttctaccgagttcggtcacgacttcttcattgacccgtgatctcttcctttttcgatcagcagaatccggtttcctttcgcgagcaaaccaccgggcattgn

SEQ ID NO: 337 - DNA (genomic), 3072 bp, PORYPHYROMONAS GINGIVALIS; double-stranded, circular
  misc_feature 1...3072
  hypothetical: NO
  anti-sense: UNKNOWN
gggcggatggttttaccctgctctttgccagtgatcgacctgatggaataggcggatatgatctgtatatgacccgtcgtgatttggaggatggcatttttctggaaccaactttgctcggtatgcctttcaattccccttacaacgattatctgctggtgtacgacgaattacgtgggatcggcttctttgccagtgaccgtttttgtcctgcggatgttgtcactgtctataccttcgttatcaatgaagaagggcgccctgtggctactgacgatatggccctcaaaagagcgtatgcatccctcaagagcataagagcgacgcaagaccctgagcgagactacagtcgtctgatcgcatcggctcgggacaaccgcaccgatgcagagaagaaggcttccgaacgtcagatttatttccctatgcaggggatgcgtatctatacgcgctggagcgacttccaaagcagcgaagccaagtcgctctatcaggatgtgatggctcggaaaagaaaattggaacaggcggctacccgtctggaagagttacgactcttgtatggaagagcatcggctttggagcgaagcggtatgaagcaggaaattcttcgtctcgaaaatgccattcctccactggaagaagaagtaggccgaatggaaaaggaagtcagaaacatggagttacaagccgtgcaaggcttttagaccaaggccgaccttttcgagagccatcttacgattgatctgtctcacctcttaaaacattaatgaacttatgaaaaccaaaagaacgattcccccctccgagctgatcatcaatacggacggttcggtctttcatctgcatattcgtcccgaacaattggccgataaggtcatattggtaggtgatcctgctcgagtggatgcagtcgcctctcgtttcgagcgtattgaatgcaatgtatccaatagggagtttcataccgtcacggggtggtatggcgacaagcgtatcacggtgcagagccacggcatcggctctgataatatagatatagtcttgaacgaactggatgctctggccaatatagacttcgatacccgccaggtgaaggatcggctacgcaaactcacactcgtaagggtggggacttcgggcggattgcaggacaatacgcccataggatcttatgtggctgcagagcgaagcatcggcttcgatggagtcatgtatttctatagcgatacggagaagatacgggatgcggccttcgaagcagcacttcaggatcaactggagtggaaaatcgaagggctgaaaccctacgtgataccggctgacaagacgctgtcggatcgaatatgtcgggaggacatcctgcgaggtgtgactattgcagccaatggcttctacggaccgcaggggcgtcgcttgcgcttacccctcaaagacgaggatctgaacaggaagatacaggctttcgacttcaatggcagccgtattacgaactatgaaatggaaagctcctctttggccggtctggctgccctgatggggcacgaagccatcacggtctgttgtatcatcgcaggcaggaaatccgaaaagatgaatacctcctatcagggaagtatagagggccttatcgatttggttctggaacgtatctgatagaaataagttacctttgtgaaccaaggtttttccccctcggacgaatggctccgatcgtgtcggttatgcagcagagcaagcaagttgctgcagggggaatataaattagaagtttttgcatgaacatactcgaactttcggaacaagaagtcgtacgccgtaacagcttagagcaactgcgtaatttggggatcgatccatatcctgcagcggaatataccgtcaatgcctattccgccgagatcaaaaggaatttcaatggcgatgagaatgtcgccaaacgtcaagtaagcattgccggacgtattatgagccgccgtatcatggggaaagctacattcatggagctgcaagatgctgaggggcgtatccagatctatattactcgggacgatatttgtccgggtgaggataaggagttctacaatacggtggtcaagaagtgtacggatataggtgattttatcggagtgaaagggtacgtattccgcactcagatgggagaaatatcggtgcatgtgcaggagatgactttcttgtcgaaagctatccgcccccttcctgtggtaaaagaaaaagatggggaggtcttcgatggcttcacggatccggagcagcgttatcgtcagcgatacgtggatctggtcgtcaatagtcatgtcaaagacattttcctcaagcgtacgatggtattcaattcgatgcgcagtttcttcaatgagtgcggatacatcgaagtggatacacctgtactccaatcgatcccgggaggtgcagctgcgcgtccttttatcacgcatcataacgctctggacattccgctctatctgagaatcgctaacgaattgtatctgaagcgtctgatcgtgggcggtttcgatggtgtgtatgaattcagccgcaatttccgaaatgaggggatggaccgcacgcataatcctgagttcacggccatggagatctatgtggcgtataaggattacaactggatgatgaactttacggagcagatgctcgaacgcatctgtatggatgtgctgggtactactcagatgaaggtgggcgggaaattgatcgacttcaaggccccctacaagcgagtgaccatgatcgaagccatccatgagcatacgggtatcgacatcagcggaatgaacgaggccgagctgcgtcaggtatgcgacaagctgggcgtagagcacaatgaaacgatgggcaaaggcaagctcatcgatgagatcttcggcgagaagtgcgagaagaactatatccagcctactttcatcacagactatccgaaagaaatgtcgcctctgacgaaggagcaccgcaccaatccggagctgacagagcgattcgagctgatggtcaatggcaaggagttggccaacgcctactcggagctgaacgacc

SEQ ID NO: 338 - DNA (genomic), 685 bp, PORYPHYROMONAS GINGIVALIS; double-stranded, circular
  misc_feature 1...685
  hypothetical: NO
  anti-sense: UNKNOWN
ccccgctctatttcaatgcagcgaggtcgaacggtttgagcttcaggcactctgctccgtttgccttctttggcagtctcatgtgggagctgcttatggaaaacgagccaccgagtatcaacgacctctgtgccaccaccataggcggtatagctttgggggagatggggcacaggctgtcggacctgctcatcgacaatcgtaccacagggtgggaacgtatggggcgcgaggtggctatcgctctgatcaatccgatgcgctttctcaaccgtctgacagcaggagaggtgacttctgtcgggagtcgcagcggacagatatttcagtctgtccccataaacatagtcgtcgatgccggctttcgctttttggcagacaagcggcatgcccgaaccggtgccacggctctgaccctgaatctgagattcgactacggcgatccattccgaagcgagactttctctccatacgatttcttccaattcaaagccggattgagtttctccgaatcgcaacctctgctgagccagatcaatctgatcggaatcctaagcggatgccaactgctcgcacacgaacgaacggttttggtgggaaggtctctttcagcacttcgactactacaattcggaaaaacgaataagcaaaaattcgagggaggtactcgtcacccataccggat

SEQ ID NO: 339 - DNA (genomic), 1038 bp, PORYPHYROMONAS GINGIVALIS; double-stranded, circular
  misc_feature 1...1038
  hypothetical: NO
  anti-sense: UNKNOWN
agaagcncactccggtagccgaagtttcgcccatgttgccgaatcccatagcctgtacgttcacagccgtaccccattctgccgggataccttccatgcgacggtagaggatggcacgctcgttcatccaagagtcgaacncggccatgatagcaccccaaagctgctcttcggcagagaaagggaagtccttacccgtctgagcctttacggctgccttgaaacgggatacnaggtctttgaggttttctacggagagttcgttgtccaagtgcacaccattctcttccttgaccttctcgattatttcttcgaacggatctatatcttccttattcgtgggcttcataccgagtaccacgtcgccgtacatctgcacgaagcgacgataagagtcccaggcaaatcgttcgttgccggtcttgcgtacgataccggccaccacttcgtcgttcagaccgaggttgaggatcgtatccatcataccgggcatggaagcgcgtgctcccgaacgtacggatacgagaagagggttctcggtgtcgccgaatttcgacttcatcagtccctcgatatttctgatcgcatcgtttacttcgccacgcagcagctccactactttgtctcggcccaatgtatagtattcctgacaaacctctgtcgtgatcgtaaaaccgggaggcaccggcacaccgataagattcatttcggccaaattggcacccttacctccgagcaggttcttcatccctgcttctccctcggccttcccattgccgaaggtgtagactcttttcttttccatttagattagtccgttcgttattattatgatttggatagttcttacttatgacaaaaagcgataaccgactccttctccgagcttccggaaggggccgttttttgttgtaaactgcaaattaacgaaaaaagagcaagatacgctactttccaccacccctcaaacccatgaacctcaaggagtatgggacagaatagtaggcgaagcatgctatatcacaggagaaaaagact

SEQ ID NO: 340 - DNA (genomic), 2458 bp, PORYPHYROMONAS GINGIVALIS; double-stranded, circular
  misc_feature 1...2458
  hypothetical: NO
  anti-sense: UNKNOWN
cctgtgtagtttggtggatagacctttgttgatagagattccggtggcatctttcgtctcgtatgtgtcgttaaagaacccatcgatcttggatatcgaaagatccggctcgaataccacttcgggtacgttcggacggtttccattgcatcntaaatcgcgcctgaccattgtgagagaaagagcgttccaatatattttcgtccatataagtattcccttcggcgaggatattttccacgcgtttggtcgtctctatggccttgtcgttgtatccgtagcgtgcatcgcctcctgtattaagggcagaggagaattcgacactgaagttgccgcccagcatcgacgaagacgtaacacctccactattgccgaagccgcgtcgaccaccgccttggggagagaagaaggtcatggatcccatctcgctgtccatctcgctaaagcccatattgttcgtattgttcgcactaccgatcaatgtccattgcttatttccatcgaaccgattgacgttccctccggccatatagcgttggtcggtaccgtagccggcctgaagcgttccgaagaggcctttctttttttcgggcttcaccgtcaggttgattacggtctcctcttctccatcatcgaaaccgctcatccgcgacagctcgctcagtttgttcagtacctgtactttattgaccatatcggccggaagattctttattgccacctgtggatctttggagaaaaactctttgccatcgacaaggatcttgctaatgtccttgccgttgatggtgatcttcccatcggatccgatctctgctccgggtagcttcttgatcagttcctcgatagaagctccctgtgctacggtataggatccggcattgaattcgagcgtatcgttgcgtaccacgacctctgccgctttagcctgcaccgtcacactctgtagaagacgggcatcttcgttcatggatatatctttgagcgtaatggtttgcccgtttctaagagatattttttcgtcgtgggtagtgtaacctacatatgaaacgcgcagaatgtagtcaccctcctgtgacgttttcaggctgaacaaccctttttcattagtggcacctgcggcaacggctacttggccggtactctgtacaagctgtacgttggcttgaatcatggggttgccttcttcgtccaatactctacctgctactccggcttgttgggcttccagcccgacgaaaccaagagaagcaaggagtattgacaacagtaattgataaatcgatcgcataagaaaagtttgaaaagaaaaataggtgctatcgttcccattctccgaaatggtattttacgatttaccctacaactgaaatagagaggaaaagagaaataagtttaaaagaccatgtcgattttccacattcggacctccccgcaactgtcgggaaacggcgacaagtatcaaggagcaagtcggatggcattcttctttggtattatttgcctcaagggagcaaacatgtatctattctatatatttccgctcatggaaaaaggtgaagaaattccgtcgaaaagtagtcgcttacagagaaatcacgaacgaaaaatgatgagattgcggtgcgatttttggggaaaatacgcgcctaaattttttcgttttggttcgtaattttttgacttctcgcgccaaaacgaaaaatttctcgcgccacgtttttacgatccacgcgcgagcattttttcagacgtaaaaacgtcggagagggaaatgccctccatctgctgttttttcgttcccgcagtggaggaaaagctcggatggaagagccttcgggacacagacccggggagccgtctttctccaaaaacacgtatctttcggagattttagctgcaaccgcccgattattatgaagcattttttcagtgctatacgccgtttcgtgccaccctataagaagtatgtggcatggagcgtggtggccaatacgctgagtgcactgctcaacctattgtctttctctctgatcatgcccatcctgcgtatcctcttcaggatagaccggcaggtgaccacttacatgccgatggatggtatagactggggtagcatggatggctggaaagctgccggagccgctctgagcaataatttcagctggtacgtaagccaacttatagaggtacgtggagcatcgtttacgcttatcatgctggggatttatctggtggtgatgacctttctgaaagtggcttcgatgtacctcggattctacagcatgattccgctgcgcacgggagtggtgcgggacattcgcaatcagatcaacgataagatcctcggactccccctttcctttttcagcgaagagcgcaagggcgatatcatggcacgcatttcgggggatgtgaatgagatagagacttcggtcatcagttcgctggatatgtt

SEQ ID NO: 341 - DNA (genomic), 497 bp, PORYPHYROMONAS GINGIVALIS; double-stranded, circular
  misc_feature 1...497
  hypothetical: NO
  anti-sense: UNKNOWN
actgctgctgtagcacacacaagcctataccgatcagaatgccgatggctgcccccgtcatggagacgagcagtccttctatccgaaagatacgagagatggtttgggatgttgctcccattgagtgaagcgtatagatgtcttccttcttttctataaggagcatggagaggctgctgactatattaaatgtagcaagtacaaggataaacaggaggatcaggtagctcatccacttctccatcgctatcaagtgagtgatttcgggatgctgtccggccaaatcgagtacttggtagctgtcccccagagtctcttttaggcggagagctatttgctctgcatcgctacccgttcgtagctgtatggccacggcttctgcttcatgatccgaataatcaagcagattgcgcagactgtctatggaaaggatgatggaattgtcctctggttgcaggccggatgcaaataccgatgccacttgccttggagcgact

SEQ ID NO: 342 - DNA (genomic), 493 bp, PORYPHYROMONAS GINGIVALIS; double-stranded, circular
  misc_feature 1...493
  hypothetical: NO
  anti-sense: UNKNOWN
tttactgccgtatcagtatccgcggaggattcgtttgatgtcgttcagcttattgagggcctccaagggggtgaggttgtcgatgttcagatcgaggatctcctctctgatttgggacaagacgggatcatcgagctgaaagaagctaagctgataaccgtcgatgctcctgcctttttcgtcccgaggaagcgtgggcgacgcatttttcaccttttcggaagggcctcgtttggtgtctttggtttttggctcctcttcctctattttctccctttcttgttcgagacgatgcaggatgtctgtggctcgctgtacgatatggtgtggcataccgccgagacgggctacttgaataccgaagctgtgtgcactgccgcccggctccaatttgcgaaggaagagcatcttgccgtccacttcgcgagccgatacattgaagttgggtacccganncgagttgccctttccagctcgtcagttcgggataatg

SEQ ID NO: 343 - DNA (genomic), 604 bp, PORYPHYROMONAS GINGIVALIS; double-stranded, circular
  misc_feature 1...604
  hypothetical: NO
  anti-sense: UNKNOWN
tcgaacaaaaagtcaaagaatatttctgcaacatcaatggatataatgatagcaatattttctggttgcataacacactatttaggcaataatagcctatttattagttgccttggggctgctattcctgtaattgcaggaaaattcatcgagaatgagacttcttccgaagaaatgagctatgaagaattcaaaaaacagctctttgagtgcagcgaggtagatgacctcatcaaacttattaataaatcgggttattgccgtccgataaaagttgtttgattgctcaccagcttttgatgatataaaaaagcaggtatcgatcctccaggatcgatacctgcttcattcaaattaaatatcatcttatcccattattgaactatgacgagggactaagctcttgcttcttgttgaagttaaaagtgatttgttgcaccttgccgaagttatcttctatatatacgtctaaagatattggtgccggcatttcatcccctttcgtcgccattttccctccgattggattcggtgccggcagaagtttttccttccgtttgtaacaaatggatccttttgcatcttcatatatacagggcattct

SEQ ID NO: 344 - DNA (genomic), 425 bp, PORYPHYROMONAS GINGIVALIS; double-stranded, circular
  misc_feature 1...425
  hypothetical: NO
  anti-sense: UNKNOWN
tgaatatagccgctgccgtaggctcgctggcagtaatggggctgatcgtttttgtcagcaccaaggtgcgcagccacgttacgctgctcattatcggcgttatgatcggatatgtagccactgccgtcatcggggtattcaagtttttcagtatcgaagaagatattcgggcatacgtaatttgggggttgggcagcttttcccgtgccacggattcgcaactgagtttctttgccattctgatgttgatctttattccggccggtatgctccttgtcaagcagttgaatctcttattgctgggagaaagctacgcacgtaatctgggactgaatactcgtcgggcacggctgctcgtgatctcttccgccggtttgctcatcgctaccggaacggcctattgcggcccatcggctttttgggga

SEQ ID NO: 345 - DNA (genomic), 678 bp, PORYPHYROMONAS GINGIVALIS; double-stranded, circular
  misc_feature 1...678
  hypothetical: NO
  anti-sense: UNKNOWN
tagaggatccccgcaaaattcattcataaaatggaaattttattgtttgttgaagccttattatatttgactaaagttacagaactatatatgaatattcgttacatacagccagatatgaatagactcaactggacgctttctgcacttattgaattatccacttttagagaggatgatttgttttctatggaattaatcaatttgcatgaaactgtcaagaaagaaatcttggaatacttgagtgatttagaaaaaggaccaatctttacttctaaaattcgagagataaaatcaaattttgaaaattcttttgtcgatattgaggagcataaggataatttgttatcagaagcaaaggaaatacataaaagcaccttggttcgatttgagaaagataaaatgtttgtgattgactttagaaatggaaatctcgaactttattcatcaaatgaccaatgaccatggcgaatgagttatgtatggcttctgtttttttgtcatatcgtttttagttgaaactacagagaaaaatgaatgaagtacctgtgattaagaaaaggacgcttgaagtcttattggaatacagcttttaaaggagcttttttctcggatattcgtggtcctggctgcattgacaagcagaacttgtggactcttgctcttcggctgatgatt

SEQ ID NO: 346 - DNA (genomic), 2242 bp, PORYPHYROMONAS GINGIVALIS; double-stranded, circular
  misc_feature 1...2242
  hypothetical: NO
  anti-sense: UNKNOWN
attctaacttccaagattgatcatgggctcaatccagatacacatgccatttttcagcaaaggccctgtacccggtcgtccataatttggcacctccggcgattcatgcatctgccgaccgattccatgtccgaccaactctcgaacgacagagtatccacgactttcgcagtacttctgtactgcactgccgatatcccctattcgatagccttctatggcaacagcaattccttcgtacaacgactccttcgtcgttttcaatagtcgaattacttccggagcaacttctcctacagcaaacgtataggcagaatctcctgtaaatccattcaaggatgtaccgcagtcgactgatacaatatcgccttctttgatgatagctttagcagaagggataccatgaaccacattctcattgaccgatacgcaaatactattggggaaaccaccataaccaaggaaagccggctcagctccatggtcacgaataaattcctctgcgaccttatcaagcatcaaggtcgaaacacccggccgaatattttttgcaacttcggccagagtctttccaaccaactgatttgcttcgcgcatcagcgcgatttcttcatctgtctttaggtaaatcatcaatatgcggaaacagagccaactctacctttaatacgcccgctcttcaacaagccatcgtaatgtctcatcaagagatggctttcgatctgttgcaacgtatccaaaacaactcccaccaaaatcagcagagaagttcctccgaagaattgcgcaaaagctgaactaactccgaacatctccgcaaaagcaggcaggatggcaactatagccaaaaacaatgctccaggaagcgttatccggtccattatcgcatcaatataatctttcgtttgttttccgggcttaataccgggaataaaaccgttgttcctcttcaggtcatcggccatctgcttaggattgatcgtaatcgccgtatagaaatacgtaaaaagaatgatcaaaatagcaaatacaagattataccaaacacttgtgttgttagacatagcactcagaaaccccgaagactgatctacattggcgaatcccaaaatagagatcggaatgaacatcagcgcctgagcaaagatgataggcatcacattggcagcatttaccttcaaggggatatattggcgtgctcccccatactgcttattaccgacaacccgcttcgcatattgcacaggtacttttcttgttccttgtaccaaaaggattgcacctgctatgacaaaaagaaggaatacaatctcagcaagaaaagcaaccaaacctccaacagcactcgttgtgcgagatgtgaactcagctacaaatgcatggggtaaacgagcaataataccgatgagaatgatcaacgaaataccattaccgatacccttgtctgtaatacgctctcctaaccacagaacaaacatactaccaccggtaagaatagcaaccgcaactatctggaaccaaaggccaccgggcatcgatgctcctacagactgcatttgcactcgcaagttcaccaaataggtaagagactgtaaaatcaaaatagcaacagtcagataacgagtccactgattgatcttcatacgcccactctcaccttctcgctgcaacttttgcattgcaggtacagcaatcgctgccaactgcataacaatcgaagcagagatataaggcataatacccaaagcaaaaatagatgcatgggagaaagcccccccggaaaacatatccaagagagccatcagtcctccagcagtctggtctttgagtgctgacaacgatgcggggtcaataccggggatcacggaccaaatgaacccaaagcgataaacgacggacggaacaataatggtcgtgagaatgcgttgacgcaaaatcctcaatcttccatatattcttgattgtttctaccgcacgcattaagcttatagttttacaacagatcctcctgctcttacaatagcttcttctgctgtctttgagaaagcatgagcttctactgtcaaagccgtagtcactgtaccattagccaatatcttaactaaagagtttcgagaaacaagccctgcagcaatcaagtcctctaccgaaatcttggtcagagagttagcctcagacaaagtttgaagcacagacagattgataggcttgtattctactcgatttatattcttaaagccgg

SEQ ID NO: 347 - DNA (genomic), 3032 bp, PORYPHYROMONAS GINGIVALIS; double-stranded, circular
  misc_feature 1...3032
  hypothetical: NO
  anti-sense: UNKNOWN
gactaaggaactgctcgtcgactttagaggatcccccggtcatgcccgtcctgccccattttggcgatcatgatacgcggctgacggccttctttctttgcaaacttctctgccaattctttggcatgggcgaagtctttatcttctcccgattcggatgagtacacgcctgaaatagttctgattactgctttatatcttcccacaaccttctcacatgcgtccgagatctcacccaaagaggcacgcagccctgcagctttgaccgcaaggtcgagcaggttaccctctttcgtctccacgcatttggtgatagcctcaagggcttcttgcaccgctttctcatcacggtgagagcggagatcgttgaggcgctctatctgctgcttacgaacagccgtattgtcgatctcaagaatatctataggatcctccttaggcagacgatacttgtttacccccacgataacctgctggtgcgagtcgatacgagcctgtgtacgggcagcagcttcttcgatacgcagcttgggtagtccggtctcgatggcttttgccattccgcccatctcctgtacttccttgatgagtgtccacgccttgtgtacgagttcgttggtcaggctttccacatagtaggagccaccccagggatcgatttccttgcagacgagagtttcctcctggatatagatttgggtattacgggcaatacgtgccgagaagtccgtcggcagggcgatagcctcatcgagagcattggtgtgcagcgactgggtatgccccaaagcggctgccatagcttcgatacaggtacgtccgacattgttgaacggatcctgctccgtcagcgaccagcctgacgtctggctgtgtgtgcgcagagccaatgacttggggttcttcgccccgaagctcttcacgatcttggcccataggaggcgtgccgcacgcatcttggcgatctccatgaagtgattgacgccgatggcccagaagaatgagagacgaggagcaaaagcatccacatcgataccggcatcgataccggctttgagatactgcataccgtctgccagcgtataggccatttcgatgtcggcggtggctcctgcctcttgcatgtggtaaccggagatcgagatcgaattgaacttgggcatattctgagaggtgtactcgaagatgtcggcaatgatccgcatcgagaattcgggcggatagatataagtgttgcgcaccatgaactctttgaggatgtcgttctggatcgttccggccatctcttcgagctttgctccctgctccagtccggcattgatgtagaaagccaggatgggcaaaacagctccgttcatcgtcatggaaacggacatcttgctcaatggaataccgtcgaaaaggactttcatatcttccagcgagcaaatggaaacaccggccttgccgacatcgcccaccacgcgcgaatgatccgcgtcatagccgcggtgcgtggccaaatcgaatgccacggacagacccttctgaccggaggccagattgcgacgatagaaagcgttcgactcttccgccgtagagaatccggcatactggcgaatagtccacggacgcatgggatacatgccgctataggggcctcgcaggaaaggaggcagaccggatacatagtcgagatgctccatgccttcaaggtcgtccttcgtatagaggggctttaccatgatttgctccggagtacgccagtcagccacgatgcccttttcttccgcccagcgcgtagcatccttagccacgaagccggcggacttaatatcgatgtctttataattaggtttcatctttgattctttgctttagggatggatactaccgaataccgaatttgtcgttgaaggcacgaagcgtttcgaggacattggacttcacatgcacataattccggatgcctttggcctcaagatccgccatacaagccggtgcaccggccactacgaactcggcacggccggcaaggatagtcgaatgcagccggagcgtactcggcatattcatcgtcactggagcagagcaccacgatatcggcttttgctgccaatgccgcatccacaccttcctccacggacttaaagcccaaattgtcgatcagcttgtagccggcacagccgaagaagttgcttgagaactgagagcgtgccagacgcatggccagattgccgatagtgagcatgaagacgacgggcgttttgccgctcttttccgttgcgagacggagagcttcgaattcggatgctcctcgactgaagttcaggggttcgatggatttgacacagttacagtcatgctctccctgagcaagagtgatcttgtcgccggcaacttccgtgaaattggggaactggttggtcccgaggaagatctcgcggcgagtcgccaccgactggtggcgtttgatattgcttgcattgacagccttctgaatgcttgctgtctcagcagcctgagtgaaaccgcccgcatcctctacggagaggaacagcttccacgcttcctctccaatggagttggtcagcgtctcgatataataagatccggccgaagggtcgataaccttgtcgaagtggcattcctctttgagcaaaagctgctggttgcgagcgatacgctccgagaagtcatcgctctgctgataggtgacatcgaaaggcaatacggttatggagtccactccggctatcgctgcagacatggtttcggtctgtgtgcgcaggaggtttacgtgtgcatcgaaaacggtcttgttccacatggacgtcgtagcatgctggtggatcttggccgtttcgttcttgtactgatcgccatacgagcccacgatctgagcccacagccagcgagcggcacggaacttggctatctccatgaagtagttggatcctataccgaagttgaacttgatacgtgaagcgatttcctccngcttgtagccggcatcggtcagcttgtccaacagctctgcgccccaagccaaa

SEQ ID NO: 348 - DNA (genomic), 614 bp, PORYPHYROMONAS GINGIVALIS; double-stranded, circular
  misc_feature 1...614
  hypothetical: NO
  anti-sense: UNKNOWN
ctgccgtcgactttagaggatccccggcagcgtcgcaaactgccggaaaggtcaaagtgacctctccccaaaaaccgagtttcagccttgggaaagttgaaatatcggttcgaccgagcatgcaaaaagcaaagaacgattacggcacagtagtcagtgttttgaaagaagacttccatggctttgcgacaggctcgataggtgcgcctgatctgaatacggtacttacctatgccttcccgggcgaatgcgaatatccctggattaacttcaaaccgggttatacccagcaacagggttggggtggagccaatgtatggcaggccggtggtactgtttgcctcaatgccgatggagagaatttctctcacctgaatacgcctatgctcaacgtttccggctatcagaacattgccatcgttcgcttcgatggagtatctgattctctcttctcctgcttgattcgggaaatcagaacattgccatcgttcgcttcgatgcccgtacggcggaaggaatggccaatcagattatgatagaagcggccgaaacgttcaatatgaagtcctacatgggaatctgctcgtgcttttcctttaccttccggttactca

SEQ ID NO: 349 - DNA (genomic), 989 bp, PORYPHYROMONAS GINGIVALIS; double-stranded, circular
  misc_feature 1...989
  hypothetical: NO
  anti-sense: UNKNOWN
cgggtcaccaaccagcgcgaacgattgctttcgggcgagaactttcccaccttcatatactcttgctgcaccagtaccatgaccatacaaatggcaaaggccgtaccgataatgccgataacgctgagcaccggattctgccggatgatttgccacgattgtctgatatatcttttcattgtttctgtctcttgtgcggttatttcgatggatgcggaaggcgtccgaatgggaaggggagaacctctgtcccgagcctccggcaccatctttgcgatatgctttttctatccttttggaagggccgaatcaaactatatactttggtctgactaaactatatagtttggtctgaccgaactatatactttggttgaaccaaactatatactttggtttggtcaaactatatagtttggtttagcccccttttgaggtcgattcgggcatctctcaagactggtcattaaaaccctgtatttcaattgattaacctacctgatgcccgtcgaacattcggatggtccggctcgtctcccgggcttgcaattcgttgtgagtgaccatgacgatggtacgtccgtcctctgtattgagccgatgaaggatactcattacttccgcccccattttggaatcgaggttaccggtaggttcgtctgcgaggataatctcgggattgcctacaatggcgcgggcaatggccacgcgttggcattgacctccggagagctgttggggataatggcgcagccgatgcgtcatttccatgcgctcgaggacttcgtacgccgccttcctccttttactttcgctcatgcggcgatagaggagcggcagcatggcgttgtccagcacgttgagcgtattgacgagatgaaaactctgaaatacgaatcccagcttttcattgcggaaagcggccaaagccttgtcgttcatggagtgtaccgtttgtccgaggatttccaccgtccccgtggtaggac

SEQ ID NO: 350 - DNA (genomic), 780 bp, PORYPHYROMONAS GINGIVALIS; double-stranded, circular
  misc_feature 1...780
  hypothetical: NO
  anti-sense: UNKNOWN
ttctataaaaccaagccacctttcatagaatatagcaaggtctggctctttatgatcagaactagaaatgactttatctgatgctatatattgggtaaaattaaatctttcatcaagtaaccatagattatgatcctcatatccgatttccctatcatccttaatcataggaaatattaggttatgcatttcactttctttatgtgattttccaccatctattcttttacgcaaatcatcaaacaattctattattctacgtctctggcaaacataatgagccaaatcattcttagctgtttctgttacatttttcaagattttatttgcttcatcttctagtgcgctatcgcaactttcgtctcccgatgagtatttatcttgcaattcctttaatgctatccttgcattttgctctttgtcaaactttattttttggaagcgcatttccaaatcaaattctgaaactcctattggaatagattccatatctacgtcttttaacaaagtcttattccaaggtgctgtagtatatacataatgttcgactttttgcttcttatcattatatcggttttctatgtcttcggaaaaatacgttttaatggattaatgaagttgttttcattattggttctcagataaatcagaataaaatgtcatcttctttttccaaaaatggaaacccatcttctttctggtggtacnattttcatctagatatttacccttggaacataccgcttttaatcatggtagtccttctggagttccatggtc

SEQ ID NO: 351 - DNA (genomic), 2431 bp, PORYPHYROMONAS GINGIVALIS; double-stranded, circular
  misc_feature 1...2431
  hypothetical: NO
  anti-sense: UNKNOWN
ccgtaggtactacctcaagcctccggatgctcgaacgtgtggtgatgcagtgttctgatggggagtcgtctgcgatcgctttcttctcggataggagcaaaagctctttcttcatatacttccgaagaagtcagattcgtgtcgctcccgacagtgatatgaagagccgtaacagagggtttctcatcgccccgatgcatcaagaggtctgtggcatgaagcaaatgtgcaccactcgaagcccttccgaacgaaagcaatacggccccgctattctctttctgaagtgctgcattctcaagctcggtctcgcgtttgaagaaaagatctatgagtcggagcaggggagtcgtcatgaaagtggtgatcagggtcatcatcaccagaattgtgaatataaccggagggaggatgccaagctcgcgtccgatggccagcacgacaagctccatcaggccacgcgtattcatgaacgcccctaagtaaagcgatgctttcttcctctctccacagaaccttgcagccacatacgtaccgccgaatttgccgataatggcaatcaaggtgaaagcacctgtcagtagccacagggaggcactgtccagcaaccccaacttcgtttgcaaaccggaactgacaaaaaacagggggagaaaaagggtgagagaaacgtcttctaccttctctgtcaaaatcttgcggaattggacattctcgggcattaccaatccgagcatgaaagctccgaaaagggcatgcatactcaatagttccgtagcgtaggcacttgccaatagcaaaacgaaaataaagccgatcatcgtcttgctcacgacctcctgattgtcataaagtcgtccgatcaccttgaagaaaggtcgcacaagtccgaatataaccaagaggtacaggatgaggaagagaaagttgtatatggcactgagaaagctgccactctgcgtaatggccattactccggcgagcatcaaccatgcagaaatatcccctgctgcagctgtactgatagaaagcatcccgagatggcttttccctaattgacgctcttgtatgattctggccaatacgggaaaagccgtgatgctcatcgagataccgataaagaggccataggggagaaaagtcgtggtatcggctgcataatccttatatgtcatatagctgatcagcaagcctaagagaaaggggataaagatacctgcatgactgatgatcatcgattggctgaagcgaggcttaatgtcattgatattcagctccatgccaatgacaaacataaacaggatgaggccgaactgactgagcagctccagattggccaaagcggacaaggggaaaaggacttcataagcctccggccaaaccgctcccaagagagatgggccgaggagtattcccgccacgatttcaccgattacagtgggctggccgattttcccgaaaaaccacgctacgagcctcgccaccgtaagaataacgatgatctgcaacaacaagacaccgatagtgtccgtgaaatggtgatgtaccgattcgctgaaagaatcgaaagcaccgaccaatccacctggcccccgaagggacatcgctttgtcgactacattggtttccaactctttcccgatagtggcgaaaagccaaagtccgatcaaaaagagaagaagcataccgacatagaatatcgttagcttgtgtgcagccgtccccgattgtttcatgtagcagatctgaatattatcacaggctaaaggtactaaaaacccaatagtgtcctaaatgtttgggaggggggcgttgttgtgtaaacccaaggggaaataccgaccgacagttgtaacgtgtgtgtgtgcaaggggaaataccgaccgacagttgtaacccctgcataggactaaccggatatgtgtgtaaacttatatgaatcccgcacatcccaactgtcaacttttttcagtacacaacagcgcgtttttatcgcaccacgaaggtcgcgagatttctgcatatgcgcaataaagagtggcttggaatattgctccggaacactatagaagaatgagtcccgagcaattcaacagtcaactttttttcagtacacaacagtgattggggggaatagacatcggggaaaagtttttctctctcttttgtcctttcattcgtatttccaaccgaaaattgcaccgaaaactgagatagatttgtttatcttcgtctattcttatgaaacgaaaatatacaagacagctctttcccgacagagagactctcactctttcccgatcagcacttcctccggccatcccagcatccgcttttaatacaggcgatcgggaagggtttgtcctcgtatcctccggaacaaacgttcctacgcagatactcggttacagccgagaagagcggttcgact

SEQ ID NO: 352 - DNA (genomic), 611 bp, PORYPHYROMONAS GINGIVALIS; double-stranded, circular
  misc_feature 1...611
  hypothetical: NO
  anti-sense: UNKNOWN
caattctttgatagctaacaatgcgttcaaatcatagaaatggcggattttagacgataaggatgccaacggatcctcgcttatagagaatcgaatgagagaaacagttttctcgcacaaggtttgtctaagggacaacacattcaactcaaaaggttcaaggtggtattgagtcaccacatcctccatatttcgctttttcaggtatgtggttacaaatggctctatcattcttttttcataaggaaaaggattggcaaatgcgctgatttccacaacaattctcgaaggaataggatttacagacacatctaaacccacctgagcatcataggagaaggcttgcttcctatattttgagcctttggatatatctgaaaaggatttatcctccgtcaagctggctgttacctctttcatcaagttggataaaagcatcttaacttgattgccactcatattctcactgatgacagcaaagtccacatcctcagaaaaccgatcaatcaatagataagccttggataaggacgttccgcccttaaatacgatttgctgactataagagctcttggataatgcacgaagtatttctgagatataatagtctt

SEQ ID NO: 353 - DNA (genomic), 455 bp, PORYPHYROMONAS GINGIVALIS; double-stranded, circular
  misc_feature 1...455
  hypothetical: NO
  anti-sense: UNKNOWN
gcgtagcccgagtcgctgtagggcgtagctcgaccccccttcggcatatgttccgaacggctataaaacaatgcggattcaatccaggaaaaatatgcaatatgctgtttatcagcatatttcatttctcagttgaaagatttcagcttcgagaggcttcgacatccgatgagacttcaaactttttccctttcattttctgatcggttatagtcaatgccccaacaagagcttgatcgataaggcggctcttatgagaatcggcaccgtatcgcttacatcgaacacacgtagatttatcgaggataaatccgtcaaattcttcgaaaggtattggtcggaaaataatcgttttgatggattctgttcttaaacgacattgacagggtgaccggaaatgaaagcccgaagattctccttgatcgtcccgagaaaggcgcaagcgccgctgcaat

SEQ ID NO: 354 - DNA (genomic), 6960 bp, PORYPHYROMONAS GINGIVALIS; double-stranded, circular
  misc_feature 1...6960
  hypothetical: NO
  anti-sense: UNKNOWN
cgagacggagagagactttcgaagaagttgctgcagttcgtgcgtgacatccggttcgatcggttgggagcattcacctattcgcacgagagcggcacctactgcgacaagaactatcaagacgatatacccgaatccgtcaaacaggaacgtcttggcgaactgatggccgtgcaggaacgtatatccgccgctcataacgaggcgaagatcggcagccgcctgcatgtggtcatagaccgtgcggaagatggcttctatgtggggcgtacggaatacgactctcctgaggtcgatcccgaggtactgatcccgttcgtctccggtcaggagttgaatcccgggcggttttatatggcggaagtgaccggtgcagagcctttcgatctctatgcacgtatagtggactgataacacccttcctaccgaaaccaaaagcagaaccggatgatacaacaggaactttggattgcacagttggctacggcttcaggtgtcgatgtatcgacctcgaacgaactatggtctcattactgtcgtttgatggggcagttcctcaccaaaggagacgctgtacggcaagatggtatcggcttgtggcaggctgtaaaagcggatgaatatgtaggaatccgtccggacggctcacgtgtgctggtaccgccgaggatagaactccggctgacgtcttcgggtgcctcggccatccgagagacgatccctcatgctcttatagacttggtgccttacacggaggaagtcgtgatgcgctggtggaaggctatccccgaactgctttcggagcttctccgaagaggacaccccgtatcctggtcgcagttcggacgcttcgagccggtgaaagaaggcgatgctctgacaggataccgcttcatcgcagaaggagagttgtcggagttgctcaacagacctttctccatgttcccccaagtcgatttgttgccgaccggagagatacccgataccattacccaaccgcttgtcgaagaaggggtttcgttcgtttcattgcacgaagagagccaagaggaagtcgcagagcctcaagagatccccgtcccagccgaaagcgataccgatacatcggtacagacggaagatgatatacttcctacacctgccgaggagaaagccttgacggaggagccgcttcccgatacggaggaggtatcacagccggcagcggaggagcctttcgtcccgatcgaagagccggcagagaagaaagcaaggaagcgaaagagagcgaggacgaccgctattgtcttcttagcagtcctgatactgggtgctactgcggcatacttgctactgtatcggatgcctgtcctctcgacaaaagagccggcccgacaagaacctttcggccggatgtcttcacccgtggatacgatcgncaagacggtcgatacggtaaagaccgtacctgccgcgacggatctcggccggatcgttatccgcaaaggggacattttagcccgtatcgccttggagaagtatggcgaccgcgtattctgggtctatatatatgaagagaacaaagagaaaatcgcagatcccaacaacattcctttgggtacggagctggtacttcctttacctgagaagtatgggatagatgcggccgatacggcttcgttgagaagagctttggctcttcagttccgaataggaatggcgaaagaacggcagtagcgttggggtttttctaattttgtggccatgagcaccaatatagatgtacaacagatcaaacagcgtttcggcatcatcggtagcagtccgctgatggaacatgccatacgagtggcagcacaggtggctcctaccgacatgtccgtcctcgtgacgggggagagcggttcggggaaagagttcttcccacagataatccactactacagcgcccggaaacatcatagctacattgcagtcaattgcggagccatccccgaaggaaccatcgattccgagctgttcggacaccgcaaaggttcctttaccggagccgtatcggatcgcaaggggtacttcgaagaagcatccggcggcacgatctttctggacgaagtgggcgaactgcctttgcccacgcaggcgaggctgctgagggtgctggagacgggcgagttcatccccgtaggagccagccagtcgcagaagacggatgtccgtatcgtagcggcgacgaatgtgaacctcaaggaggcggtagcgaacgggaagttccgggaagacctcttcttccggctcaatacggtaccgatcgaggtgcctgcgctgcgtatgcgaccggacgacgtgcccttgctttttcgccgattcgccgccgacagcgccgagaagtatcggatgcctccgctgcgcctatcggacgaagcccgtaccatattaatgcgttaccgctggcccggcaatgtgcgagagctgcgcaatataaccgacaggctgagcatcctggaggaggagcggacggtatcggcagagaccatcactcgctacctggacgctgaggggatgcaagacctccaccccgtcgtgatccgacggaacgaaacgaccgaagcggacaaacaaatcccccattacgagcgcgaaatcatctaccaggtgctatacgatatgaagaaagagatagccgatttgaaggggatgatgaaccgcctggcgcaccacgaacagccctcatggcctgtagggtcggacgtctggggcaacgacgacaagcgcaccgcagatccgaagtggggcgtcagcacgcacaaggcccccatcgcgaacgcggcagaacccgtggagccgatacaggaagccagcgaatacaccgaggatccggtttcgctggaggaggtagagaagaaaatgatttcccttgcattggaacgccacggcggaaggcgcaagcagacagccgaggaactgaagatttcggagcggacactataccgtaaaatcaaggagtatggactggaatagaaccctcgggcgatacagcctttccgctcttgcggcggtgcttatcgtcctgctgacctgctcggcatgcagcatctcctacagcttcaacggaggtgctctggactatagccgcatcaaaacgctttatatgccggatgtgaccaatcaggccacccgcgtatatcccccgttggcgcagactatgaccgaagccctccaaaaccattttacgcgccgtaccaagctcgaaatggcacgaaccaacgatgccgacatgatcatcgaggtggtcatcactaattacgacttcgctcccctcgccgtacaggacaacgatctggccgcacgcaccaaggtaaccttatccatacaggtgcactacgagaacaaggcctcccgaacagaacttcgatcgggactttacgtcttccacggacttcgacagcagcgagcagctggtggacgtacaagacgccctgctggccaatatggtcgacgacttggtgaagcaggtgtataacgctacggtagagaactggtaatcctcccccaccatgacgactaacgatctgtacgcctacatggagcacccctcgcggctttcggctgacacgctgcccgagatgaaagccctgtacgaggcctatccctactgctccaccttcgtcttcctatacctatataatatgtatgtggtgcaggacgtgcgctatgcttcggagctgcgccggctggcaccctatctgccggacaggcgcaagctgtacctgctcgtggagcaatatacgcatccggagcagctgcaacccgcctcggccgaaaaggagccggacgccttctcgctcatcgatgacttcctcgacgaaatgacccgaagcggagccgacctgccttcggagatttcttacggaggagcgagcggtatcccctcggcttcggactacttcgccgccacgtcaccggccgatcaggccgaaccgtcccgcagcatgccggtcttgtccgtgcaggcagccggcacaccggccgagagcgcacctccggcagcgaaagatccggccccgatcgccccggcggacgagctggacgaagggctcttcaccgagaccctcgcacgtatatacatcaagcagggacgttacgataaggcactgaggataataaagaccatcagtttgaattatccggaaaaaaacctttactttgcggatcaaattcgattcttagaaaagttgattattaacgacaaaaacaaaatataaagatgtacatcgtactgactattctcatcctgctcatatcgctcttccttattctggtcgtagtggtacagaactccaaagggggcggcttggcagccggcttcgcatccagcaatcagatcatgggcgtccgcaagactaccgatttcctcgagaaggccacttggtggtcggccggtatcattgccgttctggccatcgtttctactcacttcctccacacgggaaaggtcgatgagagccaaaacgtcctgaaggaaaccctggacaagaaggtgaaggaagaaaagaactctgcagtgatcaacttcggtggagatgccgctgctacggaatctgcccggcccgcgaccggagaggccactcccgaggaggggcaggcacaataaggaggaccggccccttccatatcccttgcaggagatacggggatcgacagacgtctttgtctttgagccgaggcttgagggcaaagacgttttgtttggcagggtgccgctcgccgcacgccccgggacaaggctcaaggggcggaacggacagagcctccgagggggtacgacaagcccttgcgaacggaacggacggacgtacccgaaaaaacgtctagacgttccgacaaaaacgtctagacgttttgactgaaacgtctagacgtatcgaagcaaacgtctagacgtttttcgcgaaaggtctagacgttttgacagacccgaccttttggcagaagacaagagagatgacaaagagactattcctgcccgaatgggcaccgcaagaggccgtacaattgacctggcctcacgaccgaaccgactgggcttatatgctcgacgaggtggaaacctgcttcgtccgcatagccaccgccatactccgccacgagcgactgatagtcgtttgccccgatcgcaagcgggtgttcggcctgctgcctcccgagctgcaccaccggctctactgcttcgagctgccctcgaacgatacatgggcgcgcgaccacggaggcatttccctcctcgccgacggccgtccgatgatagccgacttcgccttcaacggctggggcatgaagtttgccgcccatcacgacaacctcatcacgagacggctccacgccctgggcctgttcgccgaaggagttaccctggacaatcgcctcgccttcgtcctcgaaggaggagcactggagacggatggcgaaggtactttgctgaccacggacagctgcctcttcgagccgaaccgcaatgccggcctgagccgcacggccattatcgacacgctgaaagagagcctcggcgtcagccgcgtactctccctccgccacggagccttggccggcgacgacaccgacgggcacatcgacacgttggcgcggttcgtcgacacccgtaccatcgtctatgtccgctcggaagatccctcggacgagcactactccgacctcacggccatggagcaggagctgaaggagctgcgccgcccggacggacagccgtaccggctcgtgccgctgcccatggcggaagctctgtacgacggagcggacaggctgcccgccacctatgccaacttcctcatcatcaacggggcagtactcgtgcccacctacgattcgcacctcgatgccgtcgccctctcggtgatgcaggggctgtttcccgatagagaggtcatcggcatcgactgccgtccgctcgtcaagcagcatggcagtctccactgcgtcacgatgcagtacccccaaggattcatacgctaattccacagcaaagaactatgaaagtagcactcattcagcaagccaacacggcggacgtctgctcgaaccgggagcggctggcagcgaagatccgcgaagccgcccgacgcggtgccgagctggtcgtactcccggaactgcacaacgggctttatttctgccagacggaagacgtgcaggtgttcgaccgggcagagaccatcccgggaccgagtaccgatttcttcggcaccatcgcccgcgaagccggcgtcgtgctggtgctctccctcttcgagaagcgcgctcccgggctttaccacaatacggccgtcgtgctggagcgggacggcactatcgcagggaagtatcgcaagatgcacatccccgatgaccctgcctattacgaaaagttctatttcacacccggcgacttgggctttacccccatcccgacgtccgtcggatgcctcggcgtactggtttgctgggatcagtggtatcccgaagcggcgcgactgatggccatgcagggtgccgatatactcatttaccccacggccatcggtaccgagagtacggacctgcctgccgagcagctccgccaacgtcaggcgtggcagatcgtacagcgcggacatgccgtggccaacggtattcccgtggtggcggtgaacagggtcggccacgaggcagacccttcaggccgcaccggtggcatcacgttctggggctccggattcgtagccggaccgcagggcgaactgctggccgagctgagcgcaacggaagaggcggtggaggtagtggatatagatccctcccgaaccgagcaggtgcgccgctggtggccgttcttccgggatcggcggatcgacgctttctccggccttacggagcgtttccttcgcggctgaccatcatggcgagaggggggatggcgttccgtcccttccccctccgacaaggagccgg

SEQ ID NO: 355 - DNA (genomic), 740 bp, PORYPHYROMONAS GINGIVALIS; double-stranded, circular
  misc_feature 1...740
  hypothetical: NO
  anti-sense: UNKNOWN
ggtgccttgatttccgtttcggcaacgccgccatgcaatttgagcgcgcgcagcgtggccacgaggacggtaagcttgggtgcgacacccatttcccgacatttgatgtcaaggaatttttctgcacccagatctgcaccgaaaccggcctcggtgacggcatattcgccgaaagagagagccatctttgtggccaagatggagttacagccatgtgcgatattggcaaaggggcctccatgtacaaatgccggagtgtgctctgtggtctgtaccagattaggctttatggcatctttgagcaagacggcaatggatcctgctatgccgaggtctttgaccgtaaagggagcaccttctttggtatagccgagaagaatattttcaagacggctgcggaggtcttcaaagtctttggccagacagaggatagccatgatctcggaagccggcgtaatgtcaaaaccggtctggcgaggtattccgtccgagatggtacccaaccccgtaacggcattgcgcaaagagcggtcgttaacgtccagtacacgcttccaaagtatttcggagaggccgtcgcaagtattgcggttctgataaatatagttctccaaaagagccgtaatcatgttgtgagccgaaatgacagcatggaaatcaccggtgaagtggaggttgatgttctccatgggcagtacctgtgcatagccaccttcggcagccccccctttcataccgaa

SEQ ID NO: 356 - DNA (genomic), 7930 bp, PORYPHYROMONAS GINGIVALIS; double-stranded, circular
  misc_feature 1...7930
  hypothetical: NO
  anti-sense: UNKNOWN
tgttcatttatcggtaaggataatatcgtattccactggatcgttttcccggccatgctccgtgccgaaggttcgtttatcctgcctgacaatgtgcctgccaacgagtttctcaacctcgaaggagataagatttccaccagtcggaactggnccgtctggctgcatgaatacctcgaagagttcccgggcaagcaggatgtactgcgctatgtgctcacggccaacgctcctgagacgaaggacaacgacttcacgtggcgcgactttcaggctcgcaacaacaatgaactggtagccatattcggcaatttcgtgaaccgggcattggtccttactcataaatacttcgatggagctgtcccgcccaaaggcgagctgacggattgcgacagccgcacgatagaggagtttgcagccgtgaagcaggccttggagcatcagttggatacgttccacttccgcgaagcactgaaagaagcgatgaatctggcacgtataggcaataaatatctggccgatacggaaccttggaagctggcaaaaacggatatgaaccgtgtggctacgatcctcaatctgtctctgcagataacggccaatctggctatcgccttcgaaccgttcctgcctttctcctcggcaaaactcatgtcgatgctctccaccgactgtcctttcggctgggatcgtttgggtagtacggatctcttacccgaaggacacgtcttgggcaatcccgaattgctcttcgaaaagctggaggacagtgtgatagatgcacagattcagaaattgcaggataccaagctggccaacgaaaaggctgcccatcaggctgctccgatagccgaagacattgcattcgaggactttctcaagctggacatccgtgtgggcaccgtgctggagtgtgagaaagtgcccaaagcggacaagctcttgcgttttcgtatcgatgatggtctgagtggccggacgatcgtttcgggtattgccaaacactatgctccggaagagctggtaggcaagcaggtatgctttatcgccaatttgccgccgcgcaagctgaaaggtatcgagtccgagggcatgattctttcggcagaggatgcggatggttcgctcagggtcattatgccggcggctgaagttgctgcaggtagtcaggtgaaatagacttttaggaatactacagattgcacggtatgaagaagagacttttcggtttgctgtccgtcctgcttccgctggcgacgtttctcctcggtggatgtgcaagcaggcaggagcattcgcttcgtattatccacactacggatcttcacgggaatgtattccccactgatttcaaagctttaagaccgacttcgggtggaatgtcgcgcttggcttcctttctgaaagctgcccggtcggacagatcggagttgctgctcttcgatggtggcgacgtattgcagggcgatcctacggcctactattataactacatggacacgacgggtactcatctcttctcccgtgcgatgaactacttgcgctatgacgccgccataccgggcaatcacgacatcgagaccggccatgccgtctatgacaaatgggtagccggctgcgacttccctttcttggcggcgaacgctatcgacaccgagaccggcaagccatattgggctccttataaggtcttcgatcggaacgggctgagggtggctctgttgggctttataactccagctattcctgagtggctgccgcaaagtctgtggacgggaatgcgattcgacgatataatcgaatcggccaagtactgggtaccgtttgtgatccaaaaggaaaaacctgattttgttgtatgcgtactgcattccggcagggagaatgacaattcgaactatctcgaagatgccggtatgactctcgctcgtgaagtggcaggcatagatgtactattgctgggacatgatcatcaggagtacagccggagggtgaaaggagcagaagccgactccgttctcgtactgaatccggccaatcatttggacaaagtgtccgatgtgcgactcagtctcgctcgcaaaggagacaaggtactgcataaaagagtggaaggtggcttgacggacatatcgcggcttactcccgattcagcctttatggcgcatttctcctccgatgaagctgccgttcgccggtttgtgaacgagcctatgtgtgtttcttccaccgaaataagttctgcagacgctctgttcggcccgtctcctttcatggatctgattcatcatgtgatgctgagcgagtccggcgcggatatatcatttgcagctcctctctccatcaatacggatttgccggcggattcgatctatatgtaccacatgttcgccatctatccgtacgagaattttctttgcacgatgcaaatgacaggccgcgaaatatgtgactatttggagttttcctattcccgatgggtggcggatccgactcggcagaatggtcatctcatcctgctgaaaaaggatgtcgttgcttccgaccgtttcaaaacgatgtatccttcctttaattacagtgcggcgggaggactgcgctataccgtagacgtgaccaaaccgataggggagagggtgctcatcacgggagtgagggacaagatgtccggccaaggggtatacaagccctttgtacttgatagtgtatacacggtggccctcaattcttatcgagccaatggtgggggcggactgatgacggaaggagccggtattgcacccgaagaattgcattctcgtctcaagaactctacagccgtggatattcggcaagctctgattcgctatgtgcgccgcacgggtagggtagaagtgccttctgtctgcgattggcaatttgtgccgaccggatcggtcaaggaagccatcgcacgcgaccgaaagtttctcttcgataagagaaaaaagattactcgatgacgctgtggatggctgtggccctgcttgtgctgattgcaggcatggcttttatgacgttatggaaaccgaaagatccatggcaggccgacaacctgccgccagaaggctcttcggatcaattccgtcgcaaggggattatcgatgccgatgcctcgtctttgttggtgcctgtgcctgccgctgtggatagcctgccttgttttctcgttatcgatacggagacgaccggattgcctgccgatgaaacgcagtttatttccggagtagatgcaccggcacccgtatcggttggttggcagctgctggactttcgtttcagatgtatagaggaagtcgtttgccggctgtctaccgacgaaccggtatcacccgaggctgcagctttgcacggcatcacggatgcttcgctacacggcgatgatccgcatgaggtttacgcacgtttgcttggggctgtatcgaaagcaaaagtactgtctgcccacaatctggcctttcaccgttccgttctggtctatgatatgagacggaggggattcgatccgtctcccttgttctcccttgatgattattgtacaatggaggcgggagtcgattttactcatctgtacggaagctgtggaacatggaagctgccacgtctgaccgagctgttcggtgtcctctatttcggattgccgggcgttagaacgacctaccgcgagaaggtgcggaacgatatacgtctcgtggcagcatgtttgcatcggatgaatccgaccacaccgtctttagagtgaagaggggtaatatccccttcacggaagatccgggagccggggaaaagcaaaggagggagcgtttactccctcctcttgtcctcggatgaatccaatatgggtcggatcagatccggcacatcgatgttcagtgcttttaccttttccaattgccttcgaccttcttccgtcagattgaaataaatctttcgcttgtcgtcatgtcccagcctgcgcatgacccatcctctgtcttctgcagctgcaagcaacttggagttttgggccggcaatacgcctatttgcgaggctatttcggtcgctgatagcgaatcatcggctatcacgcacaggagcatggcctgattgagatcgcatccggcggaatccaaaagattggattccaattccctgatggcagccatcaacttcttcatcgtacagatacactctacattttccatcggctggaaggccgtagcctcgattgattgttactgcacaaatttagatgaatagattgatgttggcctcttctgctctattcatataggtggcaactccaccgatacttacctcgtcgagcaattcttcccgattgatccccattacatccatggacatctgacaggctataaactctacaccgttttccaacgcttgtttacgcatgctctccagtgagtccacatgcttttccttcatgaccatacgcatcatcttcgctcccaagccgaacatgttcattttggacagtcctaaccctttgctgttcttcggaagcatcataccgaacatcttgccccaaatgtctttcttcgctttgacggcgtgaggctttttgatggcattcaacccccagaaagtaaagaatatagtcaccggctgtcccatcgctgctgctccgttggccaatacgaatgtggccaaagccttgtccagatcatcgctgaagagaatgaatgtcttgcctttggatggagtctcgttcacgcaggtgccttcctccttgcaagcagtcttttcgatggtcactttgtatttgccctttatggtctcctgccggatcagattgtgtccggtcgtgtcgcaccaggcttgagcatcacgagcaaatccggggtcggtagccaggatgcagagctgctctcctacagctatttggtcaatggattgtttgagcttgaggatcggccccggacaggacatgccacaggcatccacctccggtacctgtgtatgggaagaaggactatcctttgcaggaagttgggcggtggcaggttggccggcagaactgtagtctgccgttatggtagaatacaagcgatagccaccgatcaggtttcgcacatttgagaaaccacattgtctcaggatgttcgaggcgaaataccccctcatccccacggcgcaatatacatagatcggtttgtcgtgaggaatttcccctatgcgtgcccttatttcctccaccggcatgctgattgctcccgggatatgctctacttcgtaggcctgtctgggacgagcatctataagggttactcgattgggatcgacctctttcatttcgcgccaatgcagaggtttcatacgacctgtaatgatattgtcggccacatatcctgccaaagctaccggatccttggccgaagagaatggaggtgcataggcttgctccgtttgcatcagatcggcgattccgcctttgcgcttgatgatttgagcgatggagtctattcgcttgtccacgccttctatgcctacacactgagcaccgtagagcataccgctctctgggtggaaggtgattttaagcgtaagcgggtaggcattgggataatagccggcgtggctgttgggctgtaccgtcactgactcatagggaaggccttcgcgcttgagagcctttgccggcaaacctgtagctgcaaccgtgagatcgaaaatcttggcaatagctgttcctatggctccttcataactccgcaatgtttgtccatgcatattatccgctacgatgcgcccttgccgattggccggccctgccaggaaattggtccacggctttccggtaagagggtgtgggtattcgatggcgtctccgatggcatagatgtccggatcggatgtctgcaggtattcattcactcggattccgcgtgccggtccgatagccaactgtgcatcagctgccagcttcgtattcggacgcactccgatagacagaaggatgagttcggcctcgattttttcgcccgagtcaagcgaagcagtcaatacttctccccgtttttcaatacttttcaccgctttgcccagatagagaccaatacctttttcttgcaggtgggcatgaacgatcgttgccatcgagaaatccaccggtgccattacctgtggagccatctcgatgacattgacagcaatgcctcgggcatgtagattctcggccatttccaagccgataaatccacctcccaccacgatggcacgtttcaccttgtgggtgtccaaataacttttaatggcatccgtatcctctacgttgcgtagcgtgaatactcccgggctatctacccccggcagtggagggacaaaaggcaaggctccgggggaaagcagcaatttgtcatagtgctcactatattctctaccattggcttcgcgcactcttatctgtttgtcggagcgatcgatggacagcacctcactctgtacccgaacatccaagttcagcagtcggccgaatttttcgggtgtctgcacgaaaagattttctctctctttgattaccccacctatataatacggcaggccgcagttggcatacgatatattctgtcctttctcgaacaagatgatttctgctttttcgtctattctccttagtctggctgctgctgtagctcctccggcgactccgcctacgattacgtatctcatatttgatttctgtttttgtttgtttttccggtgcaaacatagtaaacaatttcctgtggaaaatatattcacaggaaatcatatggtcgaaaaatgaaaaacgcataatgaagaacggaacgagagcggtgtcgggatagacaggtggcagctctaagatggtatgccttggatgtatggtaaagacgtgattgtaggacagtttccaaacgatatagaaatcataaggtttggccattgcttcgatgtcccggtcaataacctgctgtctcagaaatacgcaccgaaaatccttcgattgcgggtgcgtgtttcctgcaaatgtggagcgagatttttttcgttctcgcgcgtaaattttttgcttcccgaaccaaaacaaaaaaaatctcgcgccaccctttcaggcgtcgtaaacgagaaaatttcggcgcgtaaactaatcggtaccctttgaattaaaatttaatagacgattggaattacctttcttattattacctttgcgccccaaaaggctcaatgtaaaaggagaaaagaaggtaagaaggctatgctgctctcgttcagcgcgtatgtttgggaaccggtgtcacgttttctattgctaagcagagcaaaaaagcagatgatattgaatgtccaacagacagctatatagaaatgagattccgattagatggagagatgcctcgcctgccggcgacaatctcgtgaatgcttaaaaataggaatccgaatcggagatcggcctaattccattttgcctgaataactggtggagcaaaatgggatttcctgagaagtatcattgagtgtagttcatgactacatctctcgcgagggtcaatatcgcgtattttttattgagtagtgcggtttttgttcgcttttctgcgtataaatacgtagaagatggtggaataatgttagaattaatttttgtaagaaaaaaatgctttcctttgctatagggaagccggtaagacgtagctaatactactcctttcgcttcttttttagttatccggaaggatagttatgctgcagagagtttgtttgaagagtttaagaacaaaactttgttagtacgttgttttagtctcgtgagtcgagcgggaggtcttatgtcgaccatcttgtcgatatattctgaacactctatgtcgtgtctttgtaagtaaactgatcaccttataatatcagtacaagctgttcaagtgaagttcatgcagaatagtg

SEQ ID NO: 357 - DNA (genomic), 900 bp, PORYPHYROMONAS GINGIVALIS; double-stranded, circular
  misc_feature 1...900
  hypothetical: NO
  anti-sense: UNKNOWN
gcggacatttgcttctggctgcggtggatacggctttttatttggtacacgagcgcaaacaggccgatcgtactccgatcaatgaccgcttgcacaggctcaataccgaattggaggcttttctaagtcgctattagtcgggagagagggctactatcgttttttcttctcattcctttcatcctttgtttctttccttttcttcgaggtctttgccgtgatcggccttggacacgtgtgttgtaatactgctacttactaatttcaaagaatacaaacagaaatgggaataggaacacttttattatttacttttttggggcttgtagccggtgccactgccgtatggctgatcacgcggacactgctcaagcaaaggacagaggggattctcgccgaggctcgccgtgaagccgaggtaatcaagcagaagaagctcctcgaagtgaaagagaaatttctccaactgaaaggcgacctggaaaagcaggtggcacagcgcaatagcaagctccaatcggtggagagcaaactcaaaagccgcgaacaaaccctcaaccaacgtcaggaagatataacgaagaaggggcaggaaatggatttgatgccgtgagaatctgactgctcaactctctgtgattgaaaagaaaaagacggaactcgacgagctgaaaactcgcgaacaggctcatctggagtctctgagcggactctccgctgccgaggctaaagacagactggtggaaagcctcaaagatgaagccaaaggacaagcctctgcatacgtcaatgagattatcgaagaggccaagatgactgccaacaaagaggccaagcgaatcgtcatccaatccatccagcgcgtggctacggaaacggctatcgaaaactccgtgaccg

SEQ ID NO: 358 - DNA (genomic), 774 bp, PORYPHYROMONAS GINGIVALIS; double-stranded, circular
  misc_feature 1...774
  hypothetical: NO
  anti-sense: UNKNOWN
ggcttcaagtcgcgatcagacatgatggctccttcgagtgcaaatgcccaatcgaagattttgatgcggcagcgatcatattcgcccaacaaagtcttgacttcatccaacgtagctttgtgctcgggaaagtgggacataagtccgggtacccttcgatcgtaccggtagcgtatgtacttggaccaatccttacgcttgctcttgatttcgatcgttgccggcacaagagaaagagaattatcacccccttcaccctctttctccaagaccttagcatggacagccagcgagaattggttctcctcatccaatatgctgctatgtttttcaagtccgggcagaatatcctcttctctatcgggtcatcatcttgtntgatggccatcagcatagccgatcgtcttcttgcacgaggcggagcataaattcacgttcattgacagctcggtgaaagctccgcttgatgtcggcagccaagtcaggagggacaggcttaccggcagttcgcagttctcgctttttgtcctgtacggtcttctccatcagatgcgtgtagcaatcggcgaatttctttccgtctgacggtatataagatacagatttgccgtggatattcagctctctgcgcagtccatagaaaggctgcataccatcggggtacttggtactccaccagtccttaaaggcctcattccatttcttctttccgctttgaccttgagtagctccatgatcttgctatcgaagagatgcgatggcagatctatgggg

SEQ ID NO: 359 - DNA (genomic), 358 bp, PORYPHYROMONAS GINGIVALIS; double-stranded, circular
  misc_feature 1...358
  hypothetical: NO
  anti-sense: UNKNOWN
agtattctccgcaggaacaagtatttttaggggcatccttgaaaaggtgaaagcaccgcttatgtatggagatcgtgaggtatggggtatggctcgtgcgagcgaggatttcttttttatacttcccgttacggatgacctcactcccgtgcttttctataaccgtcttacaaacgaaccctgctttgtgtcagaccaaggaataactgagtatttcaaattcgctcaagaaggtgattacattgaagtcgaaggaagctctgtattcatggcgaatcttttgtactatcgttttttcccgacaagaattacctnctataatgctcccattgaaggtgttgcgagcaagacgggaaat

SEQ ID NO: 360 - DNA (genomic), 2680 bp, PORYPHYROMONAS GINGIVALIS; double-stranded, circular
  misc_feature 1...2680
  hypothetical: NO
  anti-sense: UNKNOWN
gtcaaaccttccttgatcttcgtaccatcacgatacaccgtgtaggtataatcggtcggggtggggctgccacccatggtgaactgaatatcatccaaaagaatgtagttcaaatccgagcaattgtagtgacggaaagcaacatacttcgtgcccgcaggcaaatctaccgtacgctcgatccatacactttgaggtttggcgccattggcttccgtggaaagaccgaatcttgctccgcccttatttattccgttaggcgtttcttcgaaaacgaccgtgaagtctccggcgttcgtgcccgtcttggagatcatcaccgcatagtgatccccgggaaaaccgtcgttgactgcatagtagtactttaccttcgttgcgcctgtaacatcctttgagatgagatagttatcaggattcaaagccattccattccatgagaaagaggctactacgttggtgccgccatgagctgtcagccatcccaattgtccggaagacagacagagccaaccctgaccatcgccatcggcatcgatagtagtccattccgctggtgcctctccatgagtagaagactcgaacgtttccgtgaagtctgcgcgcttgccgttggccttgatctcaacatcatcgaggttgatccagaagaagtccgtacagccgaagtgacggaaggcaacatacttagtacccgcaggcaactgtaccgtcttttgataccaggtgccctgaacacgagtgccacgaatggcttccggtgccgtaacaactgtcttggccgtcagcacttcttccaacaaagcgttggcgaagttggaagcgtcgttacccgtagaagatgcatacacggcatagtgctctgatgcataattggcatcttgtgcacatacccagaaagtaagcgttcctccgttaggaagagaaagctccggtgtaaccagatagttatcagggttctgagggccttcaaagttgatataagaagccgaagagacacagatcgcactgttgtgacctgcaaaagaggagcctccgggaggaggggtcgtcgtccaattgttgccgtcaccgtctgcatcgatcgtcttccatgaggcaggaataccattttcgaaggattcgttcagaacttccgcacgcttagatgccggtgcattccatttaaggattgcatccatgctgttaggagcttgttctgccgtcaggttctgtacaggattgaactgtgtcggattaatagttacgtttacgcactctttcggagatacgccggctgtgtacttcacttccacgcaatactcatgattgcccgtagctacgccgtcttcttcgaaggtcgtttcggtcaaaccttccttgatcttcgtaccatcacgatacaccgtgtaggtataatcggtcggggtggggctgccacccatggtgaactgaatatcatccaaaagaatgtagttcaaatccgagcaattgtagtgacggaaagcaacatacttcgtgcccgcaggcaaatctaccgtacgctcgatccatacactttgaggtttggcgccattggcttccgtggaaagaccgaatcttgctccgcccttatttattccgttaggcgtttcttcgaaaacaaccgtgaagtctccggcgttcgtgcccgtcttggagatcatcaccgcatagtgatccccgggaaaaccgtcgttgactgcatagtagtactttaccttcgttgcgcctgtaacatcctttgagatgagatagttatcaggattcaaagccattccattccatgagaaagagcttactacgttggtgccgccatgagctgtcagccagtccaattgtccggaagacagacagagccaaccctgaccatcgccatcggcatcgatagtagtccattccgctggtgcctctccatgagtagaagactcgaacgtttccgtgaagtctgcgcgcttgccattggccttgatctcaacctcatcaaggtcgatgtagaacatatccgtgctttggaagtgacggaaagcaacatatttcgtacctgcgggaaggtctaccgtcttctggcgccaagtaccctgtatacgaccacgaatagcttccggcgagcgaacaccttttgccgtaatcgtctcttccaacaaagcattcgtgaagttggatgcatcgttaccggtcgaagatgcatacaccgcatagtgctcggatgcataattagcatcctgtgcgcatacccagaaagtcaacttacctccgttaggcaaatccaatgccggtgttatcagatagttgtcaggggtaagaactcctataccaccaagaccgaatgactctgaatatacacaaccattgctattgtagccagcgattccgggagcatttccaggcttccagccatgcccgtcaccgtctgcatcgatcgtcttccatgaggcaggaataccattttcgaatgattcggaaagtgtagttgttccgggattcggatttggattcggatttggatttggattcggggtaccattaggtgcatcccacttaagcgttactttctggccgactgcactaccggtcaggttctgtacaggagcaaattcattggatccttctaccgtaacgtctttacataccttcggagatacgccggctgtgtacttaacttccacgcaatactcatgat

SEQ ID NO: 361 - DNA (genomic), 850 bp, PORYPHYROMONAS GINGIVALIS; double-stranded, circular
  misc_feature 1...850
  hypothetical: NO
  anti-sense: UNKNOWN
atataaatgtttcgtccaaacctaagagggctgcagtacgggcacggttgcgctgtagttgttcgtagcggagattctgaaccacagccagattgtgctcttttttgaacaaacctatctcgtatgccacttgcatccgccgagctagcaattccactatactctcatctatctgatcaatctgcatgcgccaagagatcagctcttcgtcttgcttttcggattggcgccgtgggatacgcagtcgccggaggatttgggcaagtacagtaggtgttatctgctggcttgcatcgcttagagccttatccgggcagcaatgcgactcgataattagcccgtcgaaattcatttccatggcttgctggctgacggattcgatccgatctctctgtcccgtaatatgactcggatcacaaaggatggttaacgaaggaaaacgtcttttcaaatcgaagggaatctgccaatgtggaggattgcgaaacgtcttggtcgcataggtactgaatcctctatggatggctccgatctgtcgaactccggactgccgaagccgttctagggctcctgtccacagatccaaatcgggactgatcggattcttgacgaggacaatcaccgattcgtccttgcctatcgtatcggcaatttcttgtacagcaaagggattggatgtggttcgtgcacctaaccagagtattctgataccggcttgcatggcttgctctacgtgttcgcgagtagccacttccgtggtagcaagcatatccaattcatcctgtacacgcaccaaccaaggtagccctgtttctnctactncttcgaagcaccccggcaaggtacgagg

SEQ ID NO: 362 - DNA (genomic), 3633 bp, PORYPHYROMONAS GINGIVALIS; double-stranded, circular
  misc_feature 1...3633
  hypothetical: NO
  anti-sense: UNKNOWN
acagcagtttatgatcagccggaagctgcatgcttcgcccttttctccggccctcttccgtctgttggctctcttcgccctcctttttggtgccaatgccttgatacctcatgtcgattctccctggctcgatataccccttcgttccatccccatcggagtaggggcacttgtggcagtctatgccatgcgcctgtctcccgagttcaatagagccatagacaaatatctccgtcgccgatgagcctactacgtcgattctcttctcgcctttatgccctccgctcccaaacggatgcagtatatcatcacagagggaaaacgacgcctgcgccgcctaacggtagagcctcggctcatttgcgaagcacagcagcgcaacgatgagctaaaaaagaaactatgcggcaaggaaaccatcaatgtcgtattccttgccgtgtacgattccatgtggaaatacgatgccctgtttgctgccatgctccggcatccgcgtgttcggcctgtactcatcgtttgtcctgcggacaatctgccggccggcgaacggggcgaactcctgcaaaagacgcttgctcactttcaggccaaaggcttcgatccgcaaccggcttgtcgggacaatggagaggtgagagacattcgggctgaatttgcaccggattacattttctataccacaccttacgacatccagttgcctccgccccttcgccagaggacctttcccgatatactcacctgctacagcctctatggctatcccctcgaagaatatcctgactggtacgacctcctgtttcacaatcttctggggtactactttttggtttcggaagaagaccttcgcatctactcgcgactctctcgcgtgaggggatgcaacggagtggtcagcggagcacctttgtcgatgctttctcctccgaaatgaggagtcgaacggaaaaaataatgaggagctacccctcgtaatcatcgctccgcaccattcgatagagccttggggatatagcctgtccaattttctcgattatgcggataccttcctccgactggcacggaagtacgaaaggccgattgcgctttgctttcaaaaccacaatccgatactcaagaccaaactctatgctccggaatcgtggggacgcgaacgaacagatcagtactaccgggaatgggcagatatgcctcatgccgaattggccgaaggagcttatgtcgatctcttttgtcgctcttcggctctcgtacatgattgcagtgctttcaccgtggaatatcagatcgtggggcgtccggccctctttatgcggaagaacggacgccttcctcacgggctcaaccgagctgcccaagaggccttcgcgttgcatgatatggcagattctgcggaagacatcgattcgtttctccaaaagatagcagagcgcagacccgatccagtagccgataggcgtcgggtcttcatccgggactatttgctccctccccgaggggctactgcctcagaggtcatcatcgacactttgctcacatcgcgttcgtaaaatcgtcggttctccacgcccaaaaacgtggcgcgggaactttttcgttttggttcgggaaagaaaaaattcccgcgcgagaacgaaaaaattcccacgccacttcctttcagcttttggttcgcagttcgggcgactttcggctcgtatttttccctgatcgactgaatgactctgcgccttgatgccgtttttcttctatttgtatcggttgttcttgccataggcatggcattgaactttaatcattattttcgcaccggactttgattacagtgtaattatgaaaagaatagtattgattcgccacggcgaaagcttgtggaacaaggaaaatcgctttacgggatggacagatgtggatttgtccgaaaaaggtattgaagaagccaagaaagccggcgagctcatgaagaaagaaggctttcagtttaccaaagcctatacttcctatctcaaacgtgccgtcaagaccctgaacggtgtcctcgatgtaatggacttggattggataccggtggagaagacctggcgtctgaacgagaagcactacggcatgctgcaaggcctcaacaaggccgagactgccgagaagtacggagacgaacaggtactcatctggcgtcgcagctacgacgtcccccccacgcctatggagaaagaggatccgcgctctccgttcatggatccgcgctacaaaggtgtgtgcgagaaagacctgccactgacagaagctctntgcgacacggtaaatcgtatcctcccctattggaacgagaccatattcccccacgctcaaggagcatgacgaggtattggtagcagctcacggcaacagtctgcgtggtatcatcaaggtgctgaaaaacatttcggacgaagacatcatcagcctgaacctcccgacagccgtgccttacgtttttgaatttgacgacaatctccgtctggtgaaggactatttcctcggcgatccagaagagatcaaaaagctgatggaggcagtagccaatcagggcaagaagaaataaccccccatcgccggccctttcctattctgcttttcgacagaaggcaaggagaaaaaacaagaagagagcgttgcacgaccgttagcggtgcaacgctctcttttcatttcatctttttttgctcggttgccgcagatgttatttgctccggaggtctttctcctacaagaccttgtcgtacacatgcatcagggatcgggctacggcttcgggtgagaaacgctctatataggtacgcccgtcggctatcatcttctcgcggagagagctgtcggagaggatgctgtccagcatggatgccatcatttccgcatcgtcggggtcggtgtacagggacgaagggcctccggcttcttccagacacgaacccgtggccgcaacgaccggcacgcccgaagccaaggcttcgacaatcgggataccgaatccctcgaagcgcgaaggatagacgaatacctctgctccgcgatagatgcccggcaggaaagcaaatgggacatcgtgcagcatgacgagccggtctgccacacctgatcgctctgcacactgctgcacctccgcacagtatggcgtacgcttccctacggcgacgagccgaatatgtcggtcacggcaatgtgccaaagcctccacggccagtcggaggttcttcctcgtctcgatgcttcccacatagagcaggtaacgctcaggcaaagcatatcgctccctcgctctcgactcatcctcctcggtagcctgtccgaaggccggcgaacaaccctgatagacgacatcgatccgatcggcaggcacgtggaaaaactccatcacatcgcgcttggtctgctcgcttatcgctatcaccctgtcggcacaacgggcagcatggccgtatttgagccgatacagcagcctgtccacaggcttataatagtgcggatagcgaatgaagatcaagtcgtggatcgttaccaccgtggcgatacccttgccgtatataccgagtggcaattcgtggctcagaccgtggaagagatcgatgccctctatatgcagtcgaggcacca

SEQ ID NO: 363 - DNA (genomic), 4086 bp, PORYPHYROMONAS GINGIVALIS; double-stranded, circular
  misc_feature 1...4086
  hypothetical: NO
  anti-sense: UNKNOWN
taccgtcttttggaggaattgcctaccgatccttgggatcgcccgatggatggagtcatcaccgaaagcgaaacactctttctgctgaccgttttttccttttctgttgccttcgtatgtagcccgaaagggcgaatgtatcggtgaaagagttctctcgggggattcctccgccggttgttcggggtggagccaaatcctgttgtggtctgtcttggtatagtcttccggtggtagcttgtcggttgtatgaaaagccctacttttgtaagaaaccaataaatatatacacaatgaagtttgaagtagccagcaacgtcctgttgcaacacttgcaattgattgcccgcgtcatagcttcacgcagtacacttccaattttggagtctgtacttttcgagcttgagggagatcaattacgtcttaccgctgccgatatggccaatcggatgagtacggaacttaccgtgaacaacgtagggggcgaaaacggttctttcgccgttcccgagaggatcttacttgaaccactgaaagaattgcccgatcagccgatctcttttgagataaatatggaaaccaaagccgctgaaatagcatacagcaacgggcattacagttttgtggtacaggatgtttcgacctatccggtggcagcttctttgtctcccgaagcaatcgtttctatcgttccggcggaagccttgctcagtggcctttcggctacgctctttgctaccagtcaggacgaacgccggccgatcatgacaggggtctatctggatttcttcgaggacaagcttgttttcgtaggctcggatggacagatcttggtgaagcaggaggatgctaatgtgcagagccgtcggcgtagtgccttctgcctgcctaggaaagcctgtcttctgctgcgcaatgttctgccccgactggaaggcgatgtgacactcacgtatgacagcaactatctccatatagaacttggcaattatacgctcagagcacggttgctggaaggtcgttatccgaattataatagtgtaatacctaccagcaatcctttctcggtgaaagtggatcgtgctcaactcctatccggagccaagcgcgtatctatcttctccaatccggctacgagtatgctgcgcatggagtttacccctgcaggcatccgcttatcggctaatgatatagatttctctgtggctgctgaagaacatgtgccggcagaatgtccggccgacatcaacatgcgcatcggattcaagtcggatgtctttcagacaattctgcaaggaatgccatcggaagaagtgataatgactttggctgatcagactcgtgccggtctcatactgccggcagagaatgcaccggggataagcctgtgcaatttgcttttgccgatgaagttgatcggcgaataaaaacgaattcgaatgaaattgaatctgaaaaacccgctgatcttcttcgacctcgaaacgacgggtgtggatttggtacgggacagaatcgtcgaaatctccatactgaaagtcatgcccgatggaagcgaagagtgtaaaacaaggcgtatcaatcccgaacgccctattcctcccgaatcgacagccattcacggcattagggatgaggatgtgaaggactgtccgccattccgttcggtggccaaaagtctggcgcaatggatagaagggtgtgatttggcaggcttcaattcgacgcgattcgatgtgccgatgctggtggaggagttcctccgtgccggagtggacatcgacctccgccacagaaagctcatagacgttcagacgatttttcataagatggaacctcgcacattggaggcagctactcgtttctattgtaatagaactttggaaaatgcgcattcggctgaagccgatacgcgtgctacatacgatgtgttcaaggcccaattggatcgttatgaggggacattggagaacgacatggctttcttggccgacttctcccgccagtctcgcaacgtggactttgccggccgattggtttatgacgacaacgataacgttatcatcaatttcggcaagtatcgcggccgtaaagctctggatgtattgcgtacagattccggttattacggctggatcatggatgcggattttacgctgaatacaaagcaagaatttactcgcctgcgtatgtctctgaacaatccggagaccaaataaacaagtacaagagaacttcgtgcagatgaaatcatctttggccggtaagcacatcgtcctcggtgtcacggggagtatcgcagcctacaaggctgccgttttgacccgcctgctcatcaaaaaggaggctgaagtgcaaatagtcattactcctgccggcaaggagttcattactcccatcaccctctcggctctgacttccaagcctgtcatcagcgaatttttctccggacgggatggtacatggaacagccatgtggatctcagtctctgggcggatgctatgctgatagctccggccacagcctctacgataggcaagatggcacatggcatagccgacaatatgttggtaaccacttacctttccgccaaggctcccgtattcgtggctccggctatggatttggacatgttccgacatccgagtacgcagcacaatatggagatactacgctcttatggcaatcatatcatagagccgggtgaaggcgaattggccagtcatttggtaggaaaggggcggatggaagagccggagtgcattgtggagatattggaggcttttttcaaggagaacgattgtaagcccctccttgggaagagagcattggttacagccggccctacatacgagaaactcgatcctgtacgttttctcggcaactactcttccggaaggatgggcttctgcatagcagaacgtttggccgaattgggggcttcggttacgcttgtcaccggccctaccactatgcagacaactgtcgaagggatagaccgtatcgatgtggaaagtgccgtagagatgctcgaagcctgtcggaaaccttttgaaaaggccgacataaccgtcttgtccgcagccgtggctgactatcgtccggcagagcaggcagagaaaaagatgaaacgagagaccaagggcgacttcgatcttcgcttgactgctaatccggatatagcggctacgctcggagcactcaaacgtgcaggacagcggttggtgggttttgccttggagacggacagtggggagcaagaggctatgcgcaagatgaaagccaagcacttggatgcgatagtactgaattcgctttccgatgcgggagccggatttggagtaggtacgaataagatcaccatattcgacagtgaaggccgaccgtcggactatccgctcaaaagcaaggtcgaggtggccgaagatattgtggactatataatcggattgggatgagaaggagattgtggtggggcctgtggatctgcctgtttttctatacggctctgctgtaagtcaggagttgaatgccaaggtaactatcaatagcgaacgtctcggcagtaatgccaatgcggagacattcaagacattggagcgtcagctctcagatctcctcaacctgactcgatggacaacggccacattcagttttgcagagcgtatcgactgcacctttttccatcaaccttaccgaagtgaaagacgaaagtcaatacaaggccgaactctttgttacttctcgtcgccctatttacaattcctcctatttttctcctcagcttatttggcgagatcaggaactgaacttcgaatacaaccagttcgatcccatcgaatataatgagacggatctgcaaagtaatctggttgcctccgtcgtattctatgcctactttatattggcgatggattttgacagcttcagccctttgggaggcaattcggcccgttctatgatgcgtcagatcgtagccagagcacaggccaaacaagactggagcggctggaaagcttttgagagtaccaagaatcgctatgcccttgccgaggctatgaatgatgccgaattggagactttgc

SEQ ID NO: 364 - DNA (genomic), 4202 bp, PORYPHYROMONAS GINGIVALIS; double-stranded, circular
  misc_feature 1...4202
  hypothetical: NO
  anti-sense: UNKNOWN
ttcggtctctttaaggtggccaatgtggccgggggacggagatgatgaggaggaggaaagcagagatgcccttgagttagtcaatcaagccatcggcaaagacccggatgagacttatacaatcaccctctcatgcggacgactgactaccggtgtaagcattaagccttggaccggcgtcttcatgatggccggttcatatagtacctccgcatccggctatatgcaaactatcttccgcgtacaaacgccttatacccacaatgggtacatgaagacagagtgttatgccttcgactttgctcccgaccgcaccctccgtgtccttgccgaggctgccaaggtatcatacaaagcaggcaaacagagcgagagtgatcgcaagctgttgggggattttctcaacttctgtcccatcatctctatagaaggcagccggatgaagccttacgatgtcaatacgatgctcggacagctcaagcgcgcacaaatagaaaaagtggtgcaggatggctttgagaatggggcactctataatgacgagctactcaaacttaccgaggtagagctgcacgacttcgacgaactcaaaggtatcattggcaaaaccaaggcgatggcaaagtccggtgacatagatatcaatcaccaaggtctcacccatgagcaatacgaggagaaagagcgactggagaagaggaaaaagaaaggcctaacacccgaagagaaaaaacgactggacgaactgaaagccaaaggcgaccaacgccgagaggctatttctatcctccgaggcatatccatccgcatgcctctgatgctctatggggctgaaatgaaggatgaggataaggagctgaccattgacaattttgccaatctcgtcgatgagcagtcttggcaggaatttatgcctcgcggcgttaccaaggcggtctttcgtcgcttcaagcgttactacgaccccgacatatttcgtgaggcggggaagcgcatccgtgagatggctcgtatggcggataagttcaccatcgaggagcgtatagggcgtattgcttctatcttctctactttccgcaaccccgacaaagaaacagtactgactccttggcgtgtggtgaacatgcatctcggggacagcataggtggctactgctttatgagcgaagacttctctactcccattgcattgcctcgctacatcgagcatcagggtataacgaatgaggtattccaccccaaaagcatcattttggagatcaactccaagagcggtctctatcccctttatgctgcctataacatttatcgtacaagggtagaggaagctcgagagaagtatggcgacgtaacacgtgcctttgccttacaactgtgggacaggacgctcgaagaaaacattttcgtggtctgcaaaacccctatggcccgctatatcacgatgcgtacgctacggggtttccgtgatgtagtgactcatacagagcattatcccgatctgatagaaaacattaccagccagcccgacagcgtggtcaatatgctacgttcgggcaaaaggttctggaaaatcaacaacgacgaaaatatgaagatagacgctattataggcaacccaccgtaccaagtgatgaatcaaggcaagggtaatggctcagaccccatctaccacaaattctttgacctcgcaatggtacttgctccacagggtacacttattcatcctgctcgttttcttttcaacgcaggtaaaacgcccaaagaatggaatgaaaagatgctttcggacaagcattatagagtagtcgattattggcctaatagtgcggaggtcttccctactgtagatgtaaaaggaggaatcgcaacctcatactggaacaagaaaatgattcttggaccgattgggatgttttcggcctttgatgagcttcatcatattctgtataaagtagagcaaaccaatcctctaccattttcaaaccttgttgcacctcgagagctctatcgtattacagacgaactctaccaagagcatcccgatttgaacggaagacaaagtgcagggcacaagtacagctttggtgccaatatctttgatgtgtttcctgaggttttctttgatgaataccctcaaggaagggaagagaagatggcatgtatctatggacgagccaataagcaaagatgctataagtggtgtaagcgtagttacatcacccatccagagaactttgccaagtacaaggtgattatccccaagacaaatggctcgggggcaatcggtgaagtactcagcacaccaattattggcacgccgattatgggttatactgataccttcattagtattggggcattcgacacccgaaacgaggcagaggcttgtctgcgctatgtgaagacgaagtttgctcgcacgatgctgggtatcctcaaggcaacgcaagataaccccaaagaaacttggcgattagtccccctgcaagacttcacagcagaatcggacatcgattggacacagccggtggcggaaattgatcgccaactctaccgcaaatacggcttaaacgaaagcgaaatcgcctttgtcgaagagaaagtccgcccgatggactaaccccatataatcagttattgctgtccggtaaaatttgggcagttaggaagttcgattgccatatcaccgaaagactgtttctatacacagctgccggttttacagcttgagaccgttgcacaataaccccctctcatattgatcaagacagacacaagcattgatttgacgaagaaaggagagcttcatgcgatctctctgcaaacctcaagtaatctgaaaaacacttaagaatcagctctgcggcaaaagacttcaatgaaagtcctataaaatagttgcaaacagctgatagttagcgcattgatgggagcagaatcagctgacaatcgcgtcctgcatcggtgcaggaagcaagaatcagctgacaatcgcgtcctgcatcgtgcaggaagcaagaatcagttgacaatcgcgtcctgcatcgtgcaggaagcaagaatcaactgacaatcgcgtcctgcatcgtgcaggaagcaagaatcaactgacaatcgcgtcctgcatcgtgcagggagcaagaatcagctgacaatcgcgtcctgcatcatgcagggagcaagaaacagccgacaatcgcgtcctgcatcgtgcagggagcaagaatcaactgacaatcgcgtcctgcatcgtgcaggaagcaagaatcagccgacaatcgtttcttatttctcgcctatttgacgaggaaaggagtacttctctaatggaaacttgggaaaatttctgtttgctcgatgtccatataccggaggtttgatctttcccaaaggcactaagaatcagctctgcagcaaaagagctcaatgaaaatcccctgcaacagtctcagcttggaagaattaatcgacattctcgacttcttcgctgaccacgccggaggggtacaaaacaaaaacccgccctgcacgataagtacaggccgggatctcgcaatctaaagaatgtctcccgacagccttcgatcttcttgttaaccttaaaatctaatactattatgaaaaaaccacgacgcaaagatagaggttattttcacatttgcaaataattgtccaccaaaatcggatctttggcaaccgaaacaccttgaaaacctgtttctactgacactttgctttctgctgtacattctgcatcacccgaaggaaattctcgccccagagcaatccgagctgatcccgagtatagccacgacgtagaagctccacagtcaaattgatcaggtcattggctcctcggcaacctaccagttcgccatctccatcaaaatcggaaccgacacctacatgttcgatgcccaacaacctgacaaagtggtcgatatggtctgccgcatgctgtacggagccctcttcctcctgctcggaaataaatccggcatagagacaaacctgcaccactcccccactacgggctatggcaagggcgtcttcgtcggtcagatttcgtgtatgattacacagagcgcgggacgatgaatgactggctacaacaggggcactactgatttgcaagacatcacgaacagtggaaacagccgcatgcgatatatccaccataacccccaagcgattcatttccc

SEQ ID NO: 365 - DNA (genomic), 555 bp, PORYPHYROMONAS GINGIVALIS; double-stranded, circular
  misc_feature 1...555
  hypothetical: NO
  anti-sense: UNKNOWN
gacttttgttggataatataaaatgacatacagaattatgaaagctaaatctttattattagcacttgcgggtctcgcatgcacattcagtgcaacagcccaagaagctactacacagaacaaagcagggatgcacaccgcattccaacgtgataaggcctccgatcattggttcattgacattgcaggtggagcaggtatggctctctcgggatggaataatgatgtagactttgtagatcgtctaagtatcgttcctactttcggtatcggtaaatggcatgagccttatttcggtactcgtctccaattcacaggattcgacatctatggattcccgcaagggagcaaggagcgtaaccacaattactttggaaacgcccaccttgacttcatgttcgatctgacgaactatttcggtgtataccgtcccaatcgtgtcttccatatcatcccatgggcaggtataggatttggttataaattccatagcgaaaacgccaatggtgaaaaagtaggaagtaaagatgatatgaccggaacagttaatgtcgg

SEQ ID NO: 366 - DNA (genomic), 906 bp, PORYPHYROMONAS GINGIVALIS; double-stranded, circular
  misc_feature 1...906
  hypothetical: NO
  anti-sense: UNKNOWN
ccctcattaaaatncaggtaaacggtaactgtctaatactgagaaaatccaaatccaatagcctttctctcttagcaganaagttcatcaggtactttctttgcagaaatacagtttgcccgactctccgaaaagggaaagtcgggcaattttatgaaaggacgaaaggtaatagccctgtaaaagcctttatccttcggcgttcagcatttggagtcgcttctccagatcagggaattggctttcgggtaggagcgacgtacagatacgcatcgcttcgttgcgcttgctgcctgtcgtttttagcgtgatggcacacataccgtagcgcacaaacttctcgatcaacttgctgctatccatccccttataaccgactgtgaagtagaatccgtcagccagtggttcaatttgccgtccttatcatagacgatattgaagccgttgtcaaggaacattttcttcatgatccgagccttccggccatattcgattacagagtcgcggaagttatattctccatcattgcaggctttgagcatggcagccataccccattgtgcagagtgagtggctcccgaagacagagcatacagagccgatgatgacaatgcctcgccgaaacgcagacgcccgaatgactcttccaagtccggatactcacgctcgtagagcttgcccgatatcatgagtactccgatgcgctgaccggcatagctgaatgccttggagctggagagagccagtatataattgtccgtgtagttggctacggaaggttgatagagcggctcacccggatgggaatagtccttacggaaatccatgccgaagtatgccaagtcttctatgacgataacatcatgtttggtcgccagctcaccgatgatgcgcagttcttcgtcc

SEQ ID NO: 367 - DNA (genomic), 645 bp, PORYPHYROMONAS GINGIVALIS; double-stranded, circular
  misc_feature 1...645
  hypothetical: NO
  anti-sense: UNKNOWN
gctcgtgcctcttcgagcgcgatccgcatgtagcggatgtcatccgtggcaaaggtaggggctgtcatcgcatttcctcctctcgaaaaagcaaaggagtgtcgctttctaaccggtgtatcacttctttcatcagcgtttctcggatccaacgggagcggttctctactttgaagcggctgcaataggtctcgacggccttgtgctccgcttcgttcagtcggatctgaatggctttctttcggagcatcgtggctcgcgggagtacattgtgccgatttttcctgctcatattcagtgatgcaaatatagtccctttattctgttgtcggccggtctgcatccaccactccacggaaagtaagacggtgatgtggcgaaactccgaaacgacgaatagcggatttgtgtgcaggtgacggataacctttgttgcgctcccatccgtacatcgggaagtccttattcagacggagcatcgagtcgtcccgataggttttggccaaaatggaagctgctgcgatggagcgatagcgggcatcgcctcccacgatacagtggtgagggatttgttcgaaaggatcgaaccgattgccgtcgatcagcaatctttcggggcgaaaaggcaactgctctatggcgcga

SEQ ID NO: 368 - DNA (genomic), 5687 bp, PORYPHYROMONAS GINGIVALIS; double-stranded, circular
  misc_feature 1...5687
  hypothetical: NO
  anti-sense: UNKNOWN
cgagcagaaaggtaaggtaatagactgtgtaaagacgggctatacgctcaacgacaaagtgatacgtcacgctcatggggtggtgggagaatgaatccccgtcaacgaatcggagcagaacgaacaaggataagacatggcagaaaaaagagactattacgaagtcctcggtgtatcgaagaatgccaccgacgatgaactgaaaaaagcatatcgcaagaaggctatccaataccatcctgataagaaccccggtgacaaggaggccgaagagcacttcaaagaggtagctgaagcctacgacgtattgagcgatccgcagaagcgcagtcaatatgaccagttcggccatgccggattgggcggagctgccggtggaggtttcagcggaggcggtatgtccatggaggatattttcagtcgcttcggtgatctattcggtgggttcggcggtttcggcggattctccgatatggccggtggcagtcgcagacgtgttcgcagagggtctgacctgcgagtacgagtgaagctttctttggccgatataagtaaaggtgtggagaagaaagtgaaggtaaaaaagcaggtagtgtgcagcaaatgtcgtggcgatggcacggaagaagccaatggcaagactacctgccagacctgccatggaaccggcgtggttacacgtgtgagcaacactttccttggggccatgcagacccagagcacttgtcccacttgccacggagagggtgagatcatcacgaagccatgctccaagtgtaagggcgaaggtgtggagatcggcgaagaggtgatctcattccacatccctgccggtgtagccgaaggaatgcaaatgtccgtgaacggcaagggaaatgccgcgccccgaggaggcgtgaatggcgacttgatagtcgtgatcgccgaggaaccggatccgaatctgatccgcaatggcaacgatctgatatacaatctgcttatatccgttccgttggctataaaaggaggtagtgtggaagtgccgacgatagacggacgagccaagatccgcatcgaggcggggacacaacccggcaagatgctgcgtttgcgcaataaggggttgcccagcgtaaacggctatggcatgggagaccaactggtgaatgtcaatgtctatatccccgaatcgatcgatgccaaagatgagcaggctatcgcagcgatggaaaactcggacagcttcaaacctaccgatgctgctcgtaaggatatagacaagaaatacagagagatgctggattgaaagacaatgccattgtatggtacttgacctgagaaaagctgccggtatccggtatgcagtttgacaaacgaagtctttttgagcgatgaacaacgaatttttgcagacagaagaggatattgtccgtatgctgcgtacagtatacgaccccgaaataccggtcaatgtgtacgatctggggttgatatacaatgtggacgtaggagccgacgggttcgttaccgtcaccatgacactgacggcaccgaattgtcctgcagcagacttcatcatagaggatgttcgcatgaaggtggaaagcgtgaaaggcgtcaagggggtaaagatagacctgaccttcgaacccgaatggaataaggacatgatgagcgaagaagccatgctggagcttggattcctctaaaaacctcggctccgaatcgaatttccccatgcgttcgaagatctactttaccagcgatgcccatctcggttcgcgccatcatgccgatcctatgacagtggagaggcgtttggccgcttggttggagcgtattcgccatgaggccaaggccatctacttcatgggcgacatgttcgactattggttcgagtatcggtatgtggtgcctcgtggcttcacgcgtttcctcgggaaagtagccgaattgagcgatgagggggtggagattcatttctttgccggcaatcacgacgtatggctgacagattatttgaccaaggagctgggtgctcatgtccatatgcatggcattacggtggagttgtccggcaagctcttccgcttggcacatggagatgaggagtatcggtctgtgaagcgttcgtacgactgcatgtaccgcctcttccgcaatccgttggcacgcctcctttatgcagccgtgcatcctcgctggacagtcggtttggcctatggcatttcactgaaaagcagacgcagcggagagaagcgaaagacactcggcaatatcccccacgcctacagcaacgactacttcgatatagaaaacgaatggctgattcgctttgccaaagagcatagtgcccgacatcccgaagtggatttctatattttcggccatcgacatctgctggtcgatatggcattgcgcgatgagaagcgtgtcctgatccttggcgattggattcgttacaactcctatgccgtttgggatggcacgacgcttgtgctcgaatccatggaggacatggaataagccttcggtaccaagatcgggacagaccgcttgataaaatacgacttcacgcccgttcagggtataaacgaaaatagctctatgggaaagataacaatcacggtaggcgatattactcgcttcgaaggagatgccattgtcaatgcggcgaatcatacccttttgggtggagggggagtggacggagccattcaccgagcagccggccccgaactgcttggaggagtgtcgcactctcaacggttgccctacgggagaaagcaaaataacgggaggatacaatctgccggcgcaatacgttattcataccgtaggccctgtgtggcatggagggcaacatggagagccggagctattggcttcctgctaccgtacatcgctgtccatagctttggacaagggactgaaatccattgccttccctgcatcagtaccggcgtttaccgttatcctaaagatcaggccgcccgcattgctttggccactatcggggagattattgcagatcgccccattgacgtcactatcgtgtgcttctcggaagcggataaggagttttatatcacacaggactgacgcgtaactccttggccttctcgcaagatctctatcgaaaagccttgcagtatactccgccttcttctctcttctctattcagttcgctctcacccccccaagggttcccttccaagaccccttagggatcccccctgagacccctaaggggtcctacccgagactccttaggggtcccataggagactcctcgggggtctcaacagggactcctaagggatcgtccccatacttcttgatgtcttcggagaaggttttccaaagagacttttcccctcctcctctctgcacgcttgccctgaatctgtgctgtcagcgtcacgtttttttttacatttgtgcctaataagctaactctcgaggctaatgggaaaattgttacaggataaattggctcagtataccgagccgcaaaaggcacaagccgcaggtatttacccttatttcagaaaaatcgaaagtgatcaggataccgaggtcgttatcgatggtcggaaagtcctcatgttcggctccaatgcatatctgggactgacgaaccacccgaaagtcaaggaggcagctatcgaagcgacaaagaagtacggtacgggctgtgccggctcccgcttcctcaacggcacactcgatattcacctcgaactggaaaaacggctggccgagttcgtcggcaaggaagatgccatcagcttctctaccggcttccaagtgaatctgggcgttgtctcctgcatcaccggccgcgaggattatatcatctgggacgagttggatcatgcttcgatcatcgagggtattcgcctttcattcagcacgaagttaaagtacaagcataatgatatgggttctctggagaagcggctccagcagtgcgacccggagaagatcaaactgattgtggtcgatggtgtcttcagtatggagggtgatgtctgcaatctgcccgaaatcgttcgcctcgccaagcgatacaacgccaatgtgatggtggacgaagctcacggtatcggcgtgatgggcgaccacggacgcggcgtctgcaatcacttcggtctgaccgacgaagtggacttgatcatgggtactttcagcaaatctttcgcttcgctcggagggtttattgcaggagacaagagcgttatcaactacctgcgccaccacgcccgatcctatattttcagtgccagctgtacgccggcctctacggcagcggcagcagctgctctggacattatgtttagcgaaccggagcgtttagcccgattgtgggagctgacgcactactcattgaacgcattccgcagtcttggattcgaaataggtcatacatcgacacctattatcccgctttttatccgcaacaacgagaagacattccaaataacccgagacgctttcgaagaaggggtattcgtcaatccggtggtctctccggcggtagctccgtcgacacccttattcgcttttcactcatggctacgcatacgaaggagcaactcgactttgccatcgaaaagctgcataaggtattcaagcagaacggtgtcctgtaagtgtaattaatgataacagcgtgttgcggacacgctcctttggaggaggatggtaatgaatacaacgataataggagtagcaggcggaagtgcttccggcaagagtacattggtgaaaaagctctgtgaggctttcgtcgaagaagatgtgcttgtactctgtcacgattactattacaaggccaatgaccacctctcccttgaggaaagaaagaagctgaactacgaccatcccaatgctttcgacacggatatgttcgtcagggatattctctctctgaaggcaggcaaaacgatagagcgtccggtctattctttcgtagagcacaatcgtttgcaagaaaaagtaaccgttcgtcctgccaaagtgatcgtactggatggaatcctgatattcgagaacaaagagctgcgggatctgatgaatgtgaaagtattcgtcgataccgatgcggatattcgattggcgcgccgccttgtgcgcgatgtccaggaacggggacgcaatatggattcggtattggcacaatacttcagtacggttcggcctatgcacgaggattttgtggaaccatccaagcggtacgccgatctgatcattccggaaggtggattcaattcggtggcgctctcactccttgtcgaaaaaatccgatcggtgattcgtaaggaagaataacagccggatactccgatctttctctcaaaaccaaaaccttaatgcgattaaaaccaaggctttctttccaaaacagcattcctgtattgtggtggatagctgccatcgtatctgccattacgaaagctgctccgcacaggcacaataactataccatattccgctcctctttctatcatttctcccgacatcagtcgctctattcggcctatccggcagagcatcacgatgtttttctctacggccctgtcttctctatccttttcgccccttttgcccttttgccttctttcatagggatgctgctgtggctgtgcttttcggttgccggatgcctttgggctgtcagccaattacccacgagcgaaaa

SEQ ID NO: 369 - DNA (genomic), 2538 bp, PORYPHYROMONAS GINGIVALIS; double-stranded, circular
  misc_feature 1...2538
  hypothetical: NO
  anti-sense: UNKNOWN
gcagaacnccgatgacatctatatgagccttatgcgcnagtnggggctgtatgatcaggtgtggcagnccggagccatcctgctgccggttcggtccgtaggcgtaatggncgacgagcgtacctacgaatacaccgtggcactgcgtgccgtgacttctatggatgccatgagtgccgattgggtgcatttgccgtatgattttctggccaaggtgtcgaacgaaataatcaataaagtgcgtggcgtaaaccgcgtagtctacgacatctcctccaaaccccccagcacaatcgaatgggaataacaatgtcagcccatacaggaatctgtacagcgaccaccgatcctattcactattataaaaaactgctttcatgtccacgtaccaaccggaagatactcgtaaggtaactacacatcgcctcatcgagatgaagagccgtggggagaaaatctccatgctcacagcttatgactactcaatggctaagctggtcgatgaggccggtatggatgtcattcttgtaggtgattcggcttcgaacgttatggccggcaatgtcaccaccctgcccatcactctcgatcagatgatctaccacggcaagtctgtggtcaaggccgtcaagcgtgctcttgtggtcgtagatcttcctttcggatcctatcagggcaactccaaagaagccttgtgctcggccatccgtgtgatgaaggagacacatgccgactgtatcaaactcgaaggaggagaagaggtgcgcgagtccattgtgcgaatcctctcggccggtattcccatcatgggacacctcggactgatgcctcagagcatcaataagtttggcacctacaatgtccgcgccaaggaagaggccgaagccgagaagctgcttcaggatgctcacctcttggaagaactcggatgcttcgctctcgtcctcgaaaaaataccggccgaactggctacacgtgtagcttcggagctgagcattccggttatcggcatcggtgccggaggtggtgtggacggtcaggtgctggtgatgcacgacatgctcggtatcacggaggggttcagtccccgtttcctgcgccgttatgccaatctggccaacgagatagatcgggcactcaagcattatatcgctgatgtgaagagtatggacttccccaataaggacgagcagtactgatcctgttttccctgaatcttacgttttcctcgcaattatcagcggtcgactatgcatggaatagaagaagggcttaccgaatttatcacttggtgcgattacctcggaacctttgcattcgccatcagtggtattcgtttggctgcagcccgacgcttcgattggttcggagcctatgtggtcggtgtggttacggctgttggtgccggtacggtgcgcgacattttgcttaatgtcccgccgttttggatgctccggccttcctacctttttatctctatgctcgctctcatcttcacgattgtatttcggaagtatgtagtacgactgaatcatacggttttcattttcgatactgtcgggataggcttgttcaccatagtgggtgtggctaaaactttcgagtgcggatatgcgtggtggctggccattgcgatgggtacgattacagggtcgttcggtggtatgattcgggatattctgatcaatcagacgccgcttattttccgcaaggatatatatgccatggcgtgcctgatcggaggagcggtctatgtgggactcatgtacacgactctcccgatcgaaatcatacagttcattgctgcctttattgtcgtggctgtgcggttcgtctcggtgaaataccatatcagcatccccactttccgcggggccgtataaactgttcccaaaacagaagttctcttttggtggcatcccccttgactatcatcttattacgatagccgtggagtgatattccgctctctctttatcgcgtttgccttcatatgcaaactgaaaaagtcgccaatcaaaaggcgacttttttgcttttgactgtacttatgagcgtaacgcacaagtcatggaggagctttagaggtattcatatctataacgacactgaaaaatcagtcaattgacaatgaaatctccaagaaaatgccgtgcgacagggttttacagctcatacggaacctctctccccgaacctgccatccggcagagagcagatagcatcttccatcaatagaccatagtatcctctcgtatgagaccatagtatcctctcataggagaccatagtatcctctcataggagacccatagtatcctctcgtaggagaccatagtatcctctcgtatgagaccatagtatcctctcataggagaccatagtatcctctcgtaggagaccatagtatcctctcataggagaccattctttgtatctcggggaaagatcaatgagcaggtttatggctgccaagtaaacagagatttcccaaagtttccttcaggtatatacttgaggttcgcaaagactgcatga

SEQ ID NO: 370 - DNA (genomic), 574 bp, PORYPHYROMONAS GINGIVALIS; double-stranded, circular
  misc_feature 1...574
  hypothetical: NO
  anti-sense: UNKNOWN
tacggatcatgtttccaccactgttcattatcacctaatggtcgatagtacatacccaattgctcagaagtataatttgctccctgctgaatcctttttgtcacggttacatagattgttccctttgaatcaatccccatattgggaattatatacttgacgttaggctcattactgataaaaggaggagctatttcttcccaaaagctctgtgcgtttccgcccaatacacctgacatcattaaagccaggcacagaataatttgttgaactgttgttttcatttccttttcgattattagttattnatcattttatttcatctgcatctttcgactacctacttccttgccatttacaatcagagaatatacagagcaaatccctgaaacacatcaccatatgacatatgccgaaagataaataattatatcaaaaacgacaaaatcacaaaagaaaattctctgttaccgctcaaaatcggttttcggttttcaaagcatgcctgcataaaatagcaacacctctcagatngaggaaaataaaatccgnccttgcggacaacagatcgcca

SEQ ID NO: 371 - DNA (genomic), 767 bp, PORYPHYROMONAS GINGIVALIS; double-stranded, circular
  misc_feature 1...767
  hypothetical: NO
  anti-sense: UNKNOWN
ggccaacatgggatcggatatgatgaggactttgtctgtgatgtccggcgatgctatgtattcgatgtggatgtcgaaattcaggcggtccttatacttcctgtaggcggatacaaaggcattttcacaatagtcgaaatagttgaggaagccatgatggaaaggcagtcctgctcgaaggatcgtagcgagcactactttgtcttggggtacggagcactcggcctcacccaagggcgtagtgacggtacgcacctgttgggtcatcttcttgctgatctcataggccattacttctcccacacgttctatattacgacgaaagcgcagtcgatcgttctgaatagtgacatcgcgcatctccatgacgaatctattgagaagagaatgctcggcacctaagtgtattacttccataattattgttgtgaggtaggttatgcaaatctacgaacgagatgttctaaataccgattcgcgcaaaaatacaatatctttgctgcataaggcgttgatcttacacaccaaataaagaattgaagattattctctcagatgcaattcttatataattcacgtttttcgttgagagtcgctctcttttgcctgatttgtgcctgggccggacgtacgctgtcggcgcaaacggaaaaagtacaaaatcgcccctacgccgactacaaacgctatcatcttggattccatgtagggatgcatgcccaggatttggttatctccaacaacgggtttgtacccgaagggagtac

SEQ ID NO: 372 - DNA (genomic), 443 bp, PORYPHYROMONAS GINGIVALIS; double-stranded, circular
  misc_feature 1...443
  hypothetical: NO
  anti-sense: UNKNOWN
gccaacctatcaaggaaagcaacatccaacatatactctgccgcgagccgtaggcgcgaggccttatccggagtgatagcagcaagcaactcttcgaagcgtgcacgtagaaaaatggcatcattcgatggatactcctccataatatggggagtgagtatatgttgtttgacacctatttcttcgagcagatcaattagagagagagtctcttcgatagattttgaaccgtcatccactgcaggcaacagatgacaatgtatatctatcaggtcagtcaaccatccttgttcaaagggattgacttgcttcgnttttcgcttaaaaatagaaaacatcctattcctttagctcttcttcatggggccaatcttgaatttcttcgtcttcttggcagaacgacgacggagttttcttgccttgtttgccatactccttggtgc

SEQ ID NO: 373 - DNA (genomic), 7096 bp, PORYPHYROMONAS GINGIVALIS; double-stranded, circular
  misc_feature 1...7096
  hypothetical: NO
  anti-sense: UNKNOWN
aaaagggctactacgcgcagcatcatcgggtgttcgatgatttccttgtagaagttgtccactgtcgggatcgtaatcttgagcatcacaggctcggtcatcttgtccaactgtgccagcagttctcgcttgaggatctcttctgccttagccttttcggggcagtggatgtctacctccggttcgaggataggtactaagccatgagaaagaatctcttttccccattggaattgctgctctacgatgtcgcgaataccctgctcgttggcctgcttgatcacactacgcatcttggtgccgaaaacgtggtatccgacagcttcttcacagagcttgccgagttcgggaaacggcttcatcagctgtacgccgttggcttcgtcctgaagccctttgtccactttcaggaaggggacgatgtgtcttttctcccaaaggaagtctgccgtaggcattccttcgatcttgccgcgcatggtacgttcgaagagaatcacaccgatgatcttgcccgtagcgaaagccggagaagtaatcatccgagtacgcatttggtgaatgagatcgaacatctcctcttcggactgatatgcatcgggttggataccgtatgccttcagagctttaggggtcgagccaccactctgatccaatgctcctacaaagccgggagcctgacgcatctgctgcaattgttctttgttcattgcttgtctattttaataagattagcgaaatagcttgtggtttttcttgttttcctcaaaggtagagattatttgtgagaggggacggttcgcacatgaataattgattcggaggaagggatcttgagggctaaaggtctgaggaaaatcagccctctcgaatatctactcatgattgctgcttcggagaggtctcttagcaaggataaatgcttgaaaggctnatactgacaaatgcgatgatctcactgattaagaacgcgcattgaaggatcggatacacgatatcccgtacccgatcagtttgcgtgccaaaatttttgcgcttgtggtcgctgaaaacatggcgcgaaaactttttgcttttggcgtggaaagtgaaaaattcccgcgccacaacgaaaaaattccggcgcaacttttgggaaaaacacagaccgcaattttagcgttttgggttcgtgttttcgaatgagtgagttacgggtattgctccaaaggggtgatggcgaatcattgacacgacgtgtcgtgtccgtcccgtccgagcgtgtgattcatgaaggtctataaagaggtgacactgtaagacggcaatcgtctgtgtgcggcgattttttccgtacacagccgactgcggatagatcccgatctacaggtaaacgtgcaaaccgatagtgaagtcgaaccgattgactcccatcttttccgaaactcatcccaaggaaccaccgctccgaaagagcagtactcatgctgaataagggagcgatatagtccaatcgattggcgaatccgataccctggtattcgattttcttagtgatgtcggcttcatatcgagaggcgatcagaccgaatccgtagaggttccctttcgggtgacatttatattggagtacgaacgaaagtccgttgcttagctttttctccagctgctgctccgaataagacagcccttttgtccgattcgtgatggtagaggggccgaaatggaatgaaaggtcgtgtacgggtgccttgatccgagagccgattttccccctttgacccgaatcgtacaggagcgagtcgggataaccttctccctcgttcctcacgacagaatctgacaagagcataagcccgcctatctgatgcatggagctgccgaagatagagggtcgttggtgattgatcacgtacaggatattggcaccgctttttctggtttcttcgcgagcaatctgcacggcctccgagtaggagagactccgggataggccggattcggcgatccttataagtgtcgcagacgaatagccgggtcttccgtactatcggtgggcagcgtgattattagtctgcgctcttcgttcgggagcaaatcgaaagcattgtcggagaatcgcgctccgagtgcatccgtttccacaaatagatccttcaccaaatagggtgaccgcactgtcagctcccaagtcctcaggcctgtccggcgaagctcttgcgagataggaggagccacaggtagtagcaaatccttgggcgaatgatgataatacagcgtggaggcccagacttcgccgtatgcttctcccacatcctccacaagcgacaggcgaagcaggttcgttcgctgcaattcctgtggcagccattgttcgatcgggaatggcaggacggtggggtgttcgttgtctacttcgatattcctcacccaaaaagtcggatagcgtttcccctcgaagctgatcggctcgatgcgcagtgccatccgatcctctcctttggcttcgggagcatccgatacgatgctgatcgtgcgccgttcggcatctggaacgatgataacgggttcgaaagctctgcgtacctgatagtgcaacggtttccagttcccgtagtagtctatgccggaccatgagatggccggccatgcatcgttgagttgccagtagaggctacccatgcagtagggtttggccgctcgttgggcttctaatccgatgcgcataccttgcccctgcatgatgagcgatttgaatacgaaatcatcgaagtcctttggctcgggatagtctcgccgcatatattcgagtataatctcattgcccacgctgctcttctgtctggctttcatgacgggggagtcgagctgcatgtcctccggccatgcaaagctctccaacgtttttctttcggggaaactttcaaatccgaattcgctcatgaagcgcgggatcctctctcgcaggatgccgaatggttcgcgtccgtaccatactccccagtagtggctgtcaccccagaccaaagtggctgggcgtccccagttagccgtgtcgggggatgtctctacataggcgcgtgtgggatccaatgctgccacacgctccggcagaagtcggcaaaacagcttgtcgtagtccgtgagaaacttctgataggtggatcggtcggagcgtttttgccatccccagtatttgaggccttctcgtatttcattgttgccgcaccagagagccaaagacggatgttcgcgcaatcgacggatgttgtaatcggcctcttctctcacattccgaaggaattccttgtcgcccggatagggagtgcaagcaaaagcgaaatcttgccagatgagaatcccgttcgcatccgccaactcatagaaacgttcgtcctcgtatataccgcctccccatacgcgcagcatattcatattcgcttccgagacagagcggaaaagctcctgccaatactcctccgtgcgtgcggacagcatcatggtgccggggatatagttggctcccttcatgtatagcggctttccgttgatgcggaagaagaagctgcgcccgtgggtatcctcttcacggacgaattccacggttcggaatcctatttgggttcggtaggtctgccatgtggtaccgtctttgtcctgaagacgggcaacgagtgtgtacatcaggggcaggcctatcccattgggcatccaccgatcgggggataatacggtgaaagaggtgcgacaggaaggttgcccatagcctgccgtcagctcttcgctgtgcactttccgtccgttcgggctgtacagctccacaaccaaacggacagagcggtcgttctgctcgttccaagagagaggaaagagacagtttacctgagcatcttttgtcagcgtgtaggtgacttccggtttcgatgcgaaggctactgccccttcgaaacgtatgccgacaggtcgccaaacacctgtggttaccagtcgaggcccccagtcccaaccatagtggtagggtgcttttcgagtatatacacttagcttttcgttgtggtgatcgttgtctgcagggtagtcgaaaccatcgcgctgtctcagagggcgtacttccttcatgggtgagcggaagcggatcagcagttcgtttccgctttttcgcagtagaccgggttatatccgcttctctgccgacaaacatattgtggctctccattatctttttcccattgaggaatacggtggcataggtgtccagtccttctgccataaggatggctcgtaggcttcggagttgctgttccgtgagggagaagagcagccgataatcccagtcgtgctcttccggccattgtgcctgttcctcctgaagtctgtagttgggatcgggcagcaaaccatgacggataaggtcgtactgcacgactccgggcactgtggccggcagccatgccgtgctatcatgccggctgaattcccagcccttgtcgagatggagtgtgtcggccgaaatggtatgtgccgcttgggtttggaaggttatggatatcgggatcaaccataggagaaatgttcggaaggtgttcttgctaatcatatcggaaaggagaagaatacgagggagaattattcgtttcccggcaactcctccgtctcaggacggaacgatgccggtacattctttttgggcgaaagtccgaggctgcgcatcttttcgatacgcccgacgatgttgctacgggcttcgaccaattgaccgcgggctttggcaagcgtggcaaccgtattttgggcttgttcctcggcacgaatgagtgtctctgcgaaagtgcagaacttatcgtacagcccgttggcttgctctacgattcgctgcacatttttcacttgccggtcgcgctgccatagatccagagccatccgcaaagctgcgatcaggttggtcggattcatgagcagcacgcgtttgttgtaggcctgatcccataaggtgggtttttctcgcagagccagcgtataagccggttcgttcgggatgaagagcatcacaaattcgggagctttgtcgcaatagtcctgataacttttgcttgccagttcctctatatgccggctgatgctggcgatgtgctcccccagcagtcgtttgcgctcggcttcatcctcagaggcaacgaaggaggcataggccgtaagggataccttgctgtcgatgatcacctcctgaccgttcgggtagcgaacgatcacatcgggacgcatccgtctgcccgtctcatcgtggaggagggtacgcccttcatcattggtcagggtctcttggatgaagaactcttctccttcggtcaagccgctgcgtcggagcaggttttcgaggatcatttcgccccagtcgccctgtactttggggtcgcctttgagtgcacgggtcaggttgttggcatcatcgctgagtcggctgttctgttcgatgagcttttgtagctctttggcgagagagaaacgttcgcgcgcttcttcattatagctcttttcgactttttcttcgaatagcttgatgtgttcactcagcggtttgagtatttcaccgatgcgctcttcgttcattccggaaagcttccgtgtcttgtcttcgaggatctccgatgccgtggccttgaagagtgcttgcatctcttcggatatttgtccggagcgtttccattcgcgttccaattcggaagtggttgcctgcaagcgtgtctccagttcggtacgaatacggatggcttctttctgctcctcttgcagatccgccagcttctcagtggcagcctccagttgtgctgtcagcctatctgtctcagtgttgtgcctgcgatggaagagccatacgacgagtccggcaactattgcgacgatgatgattagccagtacaaatccatttcgcctataaattttactgttttacgaacgaaggtaatcaatacgtatgagacctttcggcaataagcaggcactttgatccattcattttacagtgtgtcggccgattgttttgtgtgcttatggtatgatcaatgacacaaaacgatggcacgacggggaaaatcatccgacgaagaggtctcattcagggacgtcatgtcagcgaatcgatacaggaaagcccggaatgtatttttgacccaagtcgatatgcttacatgagaggatactatggtctattgatggaagatgctatctgctctgtgtcggatggcaggttcggggagagggaggttccgtgcgagctgtaaaaccgatagatgagattgtcgcacggcattttccgggagatttcattgtcaattgactgtttttcagtgtctgtatatagatataaatagtatcaaaagtaaccgatacaggctatggttcggaggaaaactgccatttgatacagcagatagactgagagacttgtatcaatcctcaatcttagcctgatttgcttcgacgtcttcgaaaagctaataaagtagggtttccatgatgaagccggttgcctaaccgactgtaaggagcaaagaaagagggctgtgacaaaaccgaattttgacacagcccctttcttttggaatgccaataccgacttaattaaaacaaggcatccaattctttcttgaatacgtctttggactgagcacccacgagcttctttaccacttcgccgttcttgatgaacaaaatggtggggatattacgcacgccatacttcatgggcaattccgtatttgcatccacatccacttttcctatgatagcgcgtccttcatattccgcagccagctcgtcgatgatcggacctaccatgcggcaaggaccgcaccatgtagcccagaaatccactaccatcggcttgccttcagctaccaagccgtcaaaatgttgcatctgtaatttgcagtgccataattttgttcgttttagttggttgttattcttgtttataatgattggtctattcaagtgcaaagttaatctcataagtcttcaatctattcaccagttcgggggacactttgatcagcgatttctgctgtgccagttcgacatcgaaagtctccgtatggtcatacactttgataaataaca

SEQ ID NO: 374 - DNA (genomic), 570 bp, PORYPHYROMONAS GINGIVALIS; double-stranded, circular
  misc_feature 1...570
  hypothetical: NO
  anti-sense: UNKNOWN
gcctcggacacaaagccgatgaacgtgattatggcataggcgcccaaattctgcgtcttttgggtatcaagaaaatgcgcttgatgacaaacaacccggtcaaacgtatcggactggaagctttcggcttggagatcgtagaaaatatccccctggaaactgccccaaatcgctacaacgagttctatctgcgcaccaagaaagaacgtatggggcacgagctgcacaacatcaaataagaagcgattccgcctcttaacaggttcttaaaaaggccgtcggacgtttgtcatacgttccgacggcctttctctttaatcggcgaaaggcgatgtgcatgcggtttcctcctctttatccgttatgaaactgttgcacaataacctcccacctcctcatatcgatcaagacagacacaagcattgattcgacgaagaaaggaagtatttcatgcaatctcttcaaagctcaagtatacctctgatggaaacttggggaaatttctgtttgcttggtagccatatcttgaggtttgatctttcctgaaaacacttagaatcagctctgcgg

SEQ ID NO: 375 - DNA (genomic), 621 bp, PORYPHYROMONAS GINGIVALIS; double-stranded, circular
  misc_feature 1...621
  hypothetical: NO
  anti-sense: UNKNOWN
ggncgttcataatcttctgcgttttagtttcttattagcttgatttctgagtttacgttggaatatgagttcggcaacatctacggcaggcgcattgctgtcgaataggttctctccaagcttttctatggcttcgctcaattcttcgataaaaccatcctcttttggtagcgcaggcagagaaagagcgtgctttgcattttgctctaacgcaaaagagagtttggagtagctacatgagcggtcgatatgcgaaccactaaagctgacaccatccatagagaaaataactccttcgactttctcagtttgcccctttgttttgaattgtacttcaatacctcgcttttgcagttcggaggtaagctcttgccagttcgtgcacttgggtagtgcagcttttattgcatcgaagatggcatacctaagttgatcatttcctcttaggcgatgacgttttacagcctcttttccttcgccccatttcagcaggttaagcctcggtgagttctttgcagacctttgttgagcaatacttttcattgctgtctgaaattgttttcccctcattattcacacgattgatacagatgtgtaagtgtgggtgcttccctgtcaaga

SEQ ID NO: 376 - DNA (genomic), 505 bp, PORYPHYROMONAS GINGIVALIS; double-stranded, circular
  misc_feature 1...505
  hypothetical: NO
  anti-sense: UNKNOWN
ggccgtaaagcgaaaaaaacggattccgccgctccgacagcaaccggagcacaggactggatggcttacctgtaaagaacaaggagtgtcttttcgtccgccgagaaaacgaagccttatatccgaatggtgaaaaccggaggcggggaaacccgaaaagacgaccgaaccttaaccttactatctgataccgaagggttccccgtcctcctttttccatggcggatacaaatgtattgaattataaacctgaaatccaatcgtatgaaaacacgaaaaacgatgtgtatcgccctgttgcttacgacgctcgcaaccggagcttttgcccagggcaacggcatggccggaatcaacgaagccaccaagatggtaacctcctatttcgacccggccacgaaactgatctacgccatcggagccatagtcggcctgatcgggggagtcaaagtctaccagaaattttcttcgggagaccccgattccagcnaggaccggnggcctt

SEQ ID NO: 377 - DNA (genomic), 994 bp, PORYPHYROMONAS GINGIVALIS; double-stranded, circular
  misc_feature 1...994
  hypothetical: NO
  anti-sense: UNKNOWN
agtattggcacgaaggccttcagaaaataacggtgatcaatccccttatccccacttcggaacaagggtgcaaagcctttgccgacaatacccccgtgctattcgcccatggtatcacgcacctctatgacgaactgccgcaccacnccgtgcagtcgctcaagcatcgtctcctcacctatttcggcaagaccacttactatcgtatctaccgcaaggaacgctacatcaccatccaagagcaggactatatccgtgacagctttgtccgggccggattttcatccgatctgatccgctacgatgcgatggtgtacatgtacgaactgcagagcgccatggtcaagagcgactgaatcctccgggtagtacgtaaccatcgactataggccgatggaagtttcacagctatgaaactgcggtttcatagctgtgaaactttattttcatagtcgagaaactatagttccatggctgtgaaactgtaaccggcctgcactgcaagaaaattttgccgtacgggaaaaaatttgcttgtcgcaggagagtgtatatccctccttatagaagtttgaaaaatggggcgggttattcgattcgcataattcggattaaataaatacatttgcgagaaaagcgattgccatgagtaacaggaagataaacccgtttgtcgtgacgggaaaaatcgaaccggaatatttctgcgaccgagaatccgagtcggcgcgcctcatcaagtccattgcaaacggcaataactcggtggttatctcgccacgtcgaatggggaaaacgggactgatccaattctgctatgacaaggaagaaatcggcaggaactactatactttttttatcgacatcctccacacatcgagcctgcgcgaatttacttacctgctcggccgcgagatatacgaagactctgctgccacagagcaaaaagatgatcaacctcttcgtcccgcaccctcaagtccgatcagtggaa

SEQ ID NO: 378 - DNA (genomic), 453 bp, PORYPHYROMONAS GINGIVALIS; double-stranded, circular
  misc_feature 1...453
  hypothetical: NO
  anti-sense: UNKNOWN
gcataaaaggagcgagtgaaaggggtggcagtaaggagtgaaagtagttgtaaccccccccttgaggagctacttgcacgagctcctcaagagaccattgcacggcatttttgcgacatatttgcctgcattgcttgcgtatatcaatgatatttagtattttacacgtataaacaagagcataaatatggcaaccaaacaaactgaatcggcaccaagctttctgcaagtatacactcagcttcgcagagatcgcatgaaacactctttcctgcgtcaaatcaatgccggttttgattggcgtggtatttcgcacactgctgaacaagaaatacaccaagacacagaatgcncataggtaaccctgcctacgatgcgctgttgatgttcaagaatctactcttggagacttggtatggttttgagtgactacgaaggtttgtggagtgcatc

SEQ ID NO: 379 - DNA (genomic), 856 bp, PORYPHYROMONAS GINGIVALIS; double-stranded, circular
  misc_feature 1...856
  hypothetical: NO
  anti-sense: UNKNOWN
aggatggcagttcgtatgagaatatggtgagcacgcatggacagccgctatcggctgccggagcatcattcgccgaaacggtcaagaacctcggaggcaatcccgaagagccgttcgccatcttccccgaagttcgggaaatgtatgccgctcgcttggcagaactggagcagatcatggcagagcgtcgcgaagaagagcaacgttggcgcagcacccatcctgatttggcagccaagttcgatgcgtggtttgccggtcaaacgccccaaatcgactggaaagctatagagcagaaacccaatcaggctacccgctccgcttctgccaccgtgttgggtactcttgccggagaagtggagaatatgattgtaacctctgccgacctttccaattcagacaagaccgatggcttcttgaagaaaacccacgccatgaagaaaggagatttcagtggagcattcctgcagatgggtgtatcggagctgaccatggcctgcctctgtatcggtatggctcttcatggaggcgtcattccggcttgcggtaccttcttcgtattttccgactacatgaaaccggccgttcgtatggctgccctgatggaattgcccgtcaagtttatctggacgcacgatgctttccgtgtgggcgaggatggtcctactcacgaaccggtggaacaggaggcgcaaattcgcctgatggagaagctgcacaatcacagcggccgtngctccatgctggtccttcgtncggccgatgtgcaagagactaccgtagcttggaagatggctatggagaatacgcatactcctacagctctgatcctttcgcgtcagaatatcaccgatct

SEQ ID NO: 380 - DNA (genomic), 3342 bp, PORYPHYROMONAS GINGIVALIS; double-stranded, circular
  misc_feature 1...3342
  hypothetical: NO
  anti-sense: UNKNOWN
gaaatcttccaaatggctatgctcgaacccaagctggctattttggacgaaaccgatagcgggctcgatatcgacgctctccgcatcgtagcaggcggggtaaaccgactccgctctccggagaatgctgctattgtgatcacacactatcagcgtttgctcgagtacatcaagccggacttcgtacacgtcctttacaaggggcgcatcgtcaagtcgggaggagccgagctggctctcacgctcgaagaaaaaggctacgactggatcaaggaagagataggagaataatcggatatgaaggtagaagaacaatatctgcaactcttccgagagaatcgcgaagcaatagacagccactccccacgggtactcaatgagcaacgggagaaggcgtcgatggctttcgcctcgaaggggttgcctcggtatggcactgagaactatcagcgtaccgatttgtctgaactattcggttatgactacggagtaaacctgaatcgtgtcaatttcccaatcagacagaaagaagcttttcattgtacgttgccggatttggacacggatctttgctacattgtcaatgatgcatacgataacgaatggagtcgcgtatccgaattgccggaaggagcatttgtcggcagtctgagcgattttgccctcagccatccggagatagcagctcgttattatgctcaagccgctgcacccgatcacgatggcatcattgcattcagcacgatgtttgctcaagatggattcatcatatatctgccggatggtgctgtactgaagaatccgatccagctcgtacaactgctcagagccgacatggagattctcgccaatcgtcggttactcatcatcttgggaaaagatgccgaagcctctctgctgatatgcgaacacacgctggatacgcattctttcctcgtaacggaagtcgtggagatattcgctgcggagaacagtcgattcgccttgtacgatcttgaagaaagcagcaagaataccaaacgtatagcatcggttcatgtacgtcaagccgagaattcgaatgtgacgatcaactgcatgacgattcacaacggtctgacacgcaacaactactactgccatcttgaaggagaaggggctgatctgaccttgggcggaatggctattgccgaagggaaacagcatgtcgataactacagcaggatagagcatctcgttcccaactgccaaagcaatgaactcttcaaatacattctcagccggcaggcgcagggagctttcttcggacgaatctatgtggcgaaagggcacagaaaacggcagcttatcagaacaatcgcaacctcttctggatgatacggctcgcatgtactccaagccgcagttggagatctatgccgatgatgtgaagtgttcgcatggtatgactacggggcagctggacgacgacgctctcttctatctgcgtcagcgcggcattcctctggctgaagccaagactatgcttagcgtggcctttaccgatgatgtagtcaagctggttcatatcgagcagcttcgtgaacgtctgcgcgacattatcgaacatcggttccgcggaggctgcatgcggtgtggctcctgcaatatctgctactaaaaatatttttgtctcgtcctacaaaagctttacagctattaggacaagaaaagattggtttcttatccatcagcaaggacgtccttgctgatggatttgtttttccggaggagagtcgagctacgctctacagctcttcgagttacgctgtacgggatagctcatcatcctctacggacgtcagttcgatctaagcggaaataggaaagttagggtttctgatgatttcaatattgagttcaggctttttaggcaggatgttgtaagcgatgataccggagatcaggttggtgacaaaattgttgacactgcgatgtctcgtgtgctctatctgacagacatttttgagcatatcattgaccgtttcgaacagggctctctttctcaataaaactttgtcatatagatgcatcagggagttcttcatgttctttttgattttggttatcatgtggatgtcatcgacaaagagccggtcaaaaaggttttgggaaatgtagcctctatcggcaatgagtttgccaaaaagattcttggtgaatgttccgtctttcagaggttctctgtcatcacaattgcccggtgtgatttgatagttgatgatttcacccctgtcgttgataacaatatgtagcttgaatccataaaaccaacccatggtgcttttgcctttttgagcccatcccctcattgtcctatgcccacgagctcgtttgatatgacaaaccttcagtggggtggaatcgatgaaagagatgcctgtacattgacccaaacaacacatattgagaaatgctatcagcttgaaacccaccctgctttgcagctccacaaagcgattataagagacaagatgtggaaactcggatcgacaagaatgggtaatgtattgaagataaaaagctttcaaatctcggtatcttgacagatgaaacaggatcaggatggtcatgacctcactgtccgacatcttaaactttctattcctgcattttttgtctgcctcttcgagggtctttttcttgattgtttcatcaaaaagcttggagaaatcatctatgatgcaaaaaacatcaactatatttgtcttcataaagtagcgttttgtttgttcgtatcttattgattatcaactgctaagatacaaataattcgctactttttcaagcataatgcccatgttctttgggcgtttaccactaatcagaaaacaaattcattggctttttcttacgtcgaactgacgttatttttaaggtcaacgtaatccattgagccatatggttcaatggaaaagcgcaatttttaattccccctcgtattcagaagaaactcgctcgaatgaacccacaacaactgataagcatgcaattttaatgcgtcagccctagggaatatgtaactcggcacggcctcggtaactactgtaaacaaccgaggcagacaaattttaactatcgaggttaagcgtgcagcgatgacataatggcactagtactaccaaataaaacaatcgagacatcgctctactaataacttcctgtcaaactttatggacagaattgactatcaaaccctacaaaaaagacatctctgaatttggaaaatatcgaaaattatgatttagtcgcataaacttacatcgaactcaccttatgagacctttgaaaaataaggagatggagggaaaaggagaaagcaaa

SEQ ID NO: 381 - DNA (genomic), 558 bp, PORYPHYROMONAS GINGIVALIS; double-stranded, circular
  misc_feature 1...558
  hypothetical: NO
  anti-sense: UNKNOWN
ggagaattgctgtttgcagattttatttcgttcgaatcctgacanaagtacgaatttttgtgccctctacatttcattttcgcttaagtttcgaaccgcttcgaaggtgtggcatgtacagaaaaagggttgacagttggagagaatcgattcaactgtcaaccctttttccgtatggtgtcattcgccggaggaatacctgaaggtattaagcatccatgcagggtaggcccgattccgacaggcttacttccttgatagatcaggttctcccgttggatcagcgcagggctgcagaaagcttatcggtcagttcttcgccatgcagattacggccgatgatagtgccgtcgttgtcgatcagcagggtatgagggatagaatggacgccgtattgcatagctgccgggcttgcccagnctttgtaatcggacatttgcggccatgtgataccgagccttgcgatggctttcttccatgctcccggattttcatcgagcgaaacccctacgatctcaagtttccccttgtagtcggcataaaccttgatcagatcgg

SEQ ID NO: 382 - DNA (genomic), 1317 bp, PORYPHYROMONAS GINGIVALIS; double-stranded, circular
  misc_feature 1...1317
  hypothetical: NO
  anti-sense: UNKNOWN
ggacggaagtatgcgcagatgaaagagcgcggccttaagatgaaggaatacgacctttataatcccaacggcacatcgctgaaagatgccgtagtgctattcgacggaggatgtacgggcgaggtcgtttccgatcgcggactggtactgaccaatcaccactgcggatacgatatgatccaggctcacagcacgctcgagcataactatctcgaaaatggattttgggcgatgagagaagcggatgaattaccgaacaaggatatttccgtggtattcatcgacaagatcgaagatgtcacagactacgtcaagaaagatctcaaagccatcaaagatcccaacagcatggactacctctctccgaagtacctgcaaaagttggctgacaagaaggccggcaagaacttttctgccaagaatccggggctttccgtagagatcaaagccttctatgggggcaatctctacctgatgtttaccaaaaagacttatacggatgttcgactggtgggagcacctcccaccagcattggcaaattcggtgccgatacggacaactggatctggcctcgtcatactggcgacttctccatcttccgtatctatgcggacaagaatggcaatcccgcaccatactctgaagataatgttccgctcaagccgaagcgtttcttcaatatctcccttggtggagtacaagagaacgactacgccatgataatgggtttccccggtactacgcaccgctatttcacggcttccgaagtagacgaatggaaaagcatcgacaacgatattcgcatccgcatgcgtgatattcgtcagggtgtcatgctcagggaaatgctggccgatcctcagatcaaaatcatgtattcagctaaatatgccgcttcgcagaatgcttacaaacgtgctataggtgccaactgggcgatcaagacacgcggcctgcgtcaaaacaaacaggcgatgcaggacaggctgatcgcatggggagcgaagcagggtactcctcgatatgaagaggccgtacacgaaatcgatgctacggtagccaagcgtgcggatctgcgccgtcgttattggatgatagaagaaggcatcatccgtgggatcgagtttgcccgttctcctatccccaccgaagatgagacgaaagctctgcaaggcaatgatgcttcggctcgcaaggaggcgatcgataagattcgtacacgctacagcaaatttgccaacaaggactacagtgcagaggtggacaagaaagtggccgtagccatgctgacggaatacctcaaggaaatgccctat

SEQ ID NO: 383 - DNA (genomic), 5395 bp, PORYPHYROMONAS GINGIVALIS; double-stranded, circular
  misc_feature 1...5395
  hypothetical: NO
  anti-sense: UNKNOWN
aaaaaattgcagattcacagccccagtggcttgcccatctatgccatcatgaacaaactcgtcaatctcgacgaaatcgcccacttaaacaaataaattcgaagcctaatcgccgaccttggaagtaagcaaagaccaaagtttatcattcgagggaagaggagcggtgagatcgatgagaacgccgctgacaggatgagtgaaacgaattcgatgggccagcagactgattcctccatccggattactgcgcccgaatccgtatttcaaatcgcccttgataggacaacccatagttgcgagctggcaacgaatctgatggtgccggccagtatgtagctctatttccaaaagatggtaattgtcggacgaagctaataagcgataagagagagaagccttcttactgttcggcactttgcataccgaagcaaagcttttgttcagtctttcgtttcgactgatataatggacgagcgtatctccatccttgggaggtctttgtttgactatggcacgatataccttttgcaccttcccatcgcgaaacatattattgagtcgcgccaaagccttactcgttttggcaaaaacgaccagtccggccacaggacgatccaaacgatgggctacaccgaggaagactttgcccggcttgacatatttctctttgatccactgcttgaccgtttcggacagagggctgtcaccagtcttatcgccttgaacaatctccccgacagccttattgactatgatcagatgattgtcttcgtaaacgacttccataatgacagccctatgaaccgaacaggttgattctgatcctatattacatattcataccgccacaaacgtggactacctgtcccgtcacgtacgaagagaggtcactgccaaggaaggtagctacgttagccacatcttcgggcgtaccaccacgacgcagaggtatctgtgccgcccattgcttcttcacttcttcgctaagcacggcagtcatatcggtgatgataaaacccggtgcaatcgcattggcacgcacgccacgtgagcccagctctttggcgacactcttggccaaaccgatcataccggctttagaagctgagtagttggattgtcctgcattgcctgatacacctaccacagaagccatattgatgatactgccggtgcgctgtcccatcatgatgggagtcacggcatggatcatgttgaacgctgacttcagattaacgttgatcacggcatcccattgttgctcggtcatacgcatcataaggccatcgcgagtaataccggcattgttcaccaaaatatcgatccgaccgaagtcagccttgatctgttccaccactgtatgtgctgcatcgaaatccgctgcattggaagcgtatgccgctgcacgtactccgagccctttgagttcttctacgaaagcctgtacgccctcatcgatattcagatcagtaatagccacatcggcaccttccgttgcatacttataagctatggcacggccgataccgcgtccggctcccgtaatgagagctaccttgttctccaataatttcatactttgattttaattagtcgtggacagatacctaccgatacgatatgtatgtccgcgaagtttatttattgatcgttaaattcttaaacactttcacttccaatctcttcttcaccgctgtttactgccggagagagacagataccgtggaagatcagatgctccacattctcactgattcgctcgaacgcgatcgttccggcatgcctaagatgtccgctgatatacggcacttccagccccttgattgagtggagtaagatcttggcggtaatatgggtatcgggtatagaaaacgcattaagccgaacaccttcgtccaaaatggaacagatcagatgttcttccttgaggtcgaactccttacgagcagtctccaccttccatatatcacgaaaaaaatcggcacgaagcgtaccattgcgcacgacaatctctttgattgcttccaaatgcgtatagatgaagtgcatcagcttcttagtcggcggcatagacacgagagcagcagtctccaacgagctgtagagttcgtccagctccttatggacaacggcaaaatagatatcttttttgcttttgaagtaagtatatagcgtgcgtcgtcccttgtttgccgcatcggcgatgtcgttcatcgtggtcttctccacaccgatcttggcaaagagctgacgtgctacatcgatcatcaagttctcttgttttcgccacactcattaaaatttttcgattgccctatattctatacggcattctgtttcggaacaaatataaggtttttggcgttgattttgcacgtttgtttcagtattgagcaaaaaagtccaccgtcttagcctgtatattggcttggacggttctatccattatccaagaaaagttcgatcgaaacaaataaaaaagctgtctcctttgaaaggggacagctcatcgatcattcttgttgtctcacaaggattcgaaccttgacaaacaggaccagaatctgttgtgctaccattacaccatgagacaatggcgaagcctttattgcttccggtgccgcaaatgtacacctttttgtgaaacaaacaataaaaacacatttggattttaattggcatccatatcttcctccatagagttcgattttgaaaagatgggttggaaatctcgattttaggttcgtaaaccggaaacacggtcaagatattttagtcaatttttctgtccgtttttgtacttttgcgagcgtaaagaccgaaaaaggtcatacatcagcatcaaagggttccatctcaataaacatcgatgaagaatatccgcaacttctgcatcattgcacatatcgaccacggcaagagtaccttggccgatcggttgctcgaatataccaacaccgtctccggcaaagatctgcaagatcaggtcttggacaatatggacttggaacgagagagaggtataacgatcaagagccatgccattcagatggactatgagatggatggagaaaagtatgtgctcaacctgatcgatactccggggcacgtggacttctcctacgaagtctctcgctccattgctgcttgcgaaggggcattgcttatcgtcgatgctgcccaagggatacaggcgcagaccatatccaatctctatatggcgatcgaaaacgacctgaccatcatccctattgtaaacaaagtggatttgcccagtgccatgcccgaagaggtggaagaccagatcatcgagcttttgggttgcgatcgttcggagatcatccgcgccagtggcaagaccggtcagggagtagatcagatccttcgcgccatcgtagagcaagtaccggcccctgccggagaccccgatgccccgctgcaatgcctcattttcgattcggtcttcaatccgttccgtggtatcatcgcctattttaaggtggtgaatggcagtattcgcaaaggagaccatgtcaagtttattgccaccgagaaagaatacgatgccgatgaagtaggagtactcaggctcgatatggagccgcgctcggaggtcaagaccggcgatgtaggctacatcatcagcggtatcaaaacaagccgcgaggtcaaggtcggcgatacgatcacccacgtagccaagccggccaaagaggctatagctggattcgaagaggtaaaacccatggtcttcgccggtgtatatccgatcgaagcagaagacttcgagaacttgcgtgcttccttggagaaactccaactcaacgatgcttcgctgacgtttcagcccgaaagttcggtggctctcggattcggatttcgttgcggatttctcggtttgctccacatggagatcgtgcaggagcgattggatcgggagttcaatatgaatgtgatcacgacggtgcccaacgtttcttataaggtgtacgacaagaaaggtggctgcaaagaggttcacaatccatcgggactgctcgaacccacgcttatagatcatatagaagaacccttcatcagagcttctgtcatcaccaatacggcctatatcggccctatcatgacactttgtttgggcaaaagaggggtgttggtgaagcaagaatatatatcgggcgatcgtgtagagatcttctacgatcttccattgggcgaaatcgtcatcgacttctacgacaaactaaagagtatctccaaaggatatgcttcattcgactatcacctgcacgactttagagagagcaagctggtaaagctcgatattctgctcaatggcgaacccgtcgatgccctgtctacactcacacacgtggacaacagtgtcacattcggccgacgcatgtgcgaaaagctcaaagaactcatcccgcgtcagcaattcgaaatagccatccaagcagctatcggagccaagatcatcgctcgcgaaacgatcaagcctgtccgtaaggatgtgacggccaagtgctatggtggcgatatctcccgtaagcgtaagctgctcgaaaagcagaaagaaggaaagaaacgcatgaagcagataggcacggtcgaagtgcctcagaaggctttcctcgctgtcctcaaactggactgatccgaggttttttcataatccctaccctattgctatggccacaacgaagtcccgcaccaaacgtcctgctccggagagcatcacagctcctttggagggacgtgttccgccacaggctcccgaactggaggaggctgttttgggggctatcctgctggaaaaagatgcctatatgcaagtgggcgaaatgctgcgtcccagtactttctacctcaaaacccatgaactgatctacgaggccattacgcagctggcactcaatcagaagcccgtggatatgctcacggtgacggagcagctcaaaaagaacggcaatctcgatgcggtcggcggcccctcttatatagccggcctgacgctgaaagtggcaagctcagccaacttggaatttcatgccaagatattggcacagaaagctttgagccgtgaggtaatcggcttttccagcgaagttctgaagaaagcttacgacgatacggaggacatcgaagatcagttgcagcaggccgagggacgattgttcgagatctcccaacacaacatgaagcaggacgtccagcctatcgacccgattatcaaagaggccttgggcgaaatccagattgcagccaaccgtaaggaaggactcagcggtcagccatccggtttccctgccatcgacaagctcacggccggttggcaggcttccgatctgatcatcattgctgcccgtcctgctatgggaaagaccgcatt

SEQ ID NO: 384 - DNA (genomic), 2224 bp, PORYPHYROMONAS GINGIVALIS; double-stranded, circular
  misc_feature 1...2224
  hypothetical: NO
  anti-sense: UNKNOWN
ggggtaaccttcgcgtatctctgagtcgtttgcaggttcgaatgtcccagcatcttacagatagtttctatggggactcctgcttccagagtaatcaatgaagcgaaggaatgccttccggcatggtaggtcaggtcttcctttatgtcggcgagaaccgcaaggcatttcatcaggcgacgtagattggggtggtacagcattggaaagagtgtcggacgggtatcgtcgttgtatttctctatcaattcaagggcttcgggcaggagtttgacacaggcttgaagttcgtttttcttgcgacggtatttaagccatagacttccttcatcatcggtgaagagattgtctcgtgtaaccgataccgcatcagcataggaagttcccgtatagcaggcaaagaggaagagatctcttgccaagatatgagagctacgatgttcgggaatgaccaagtcacggattttctcaaaggattcccgacttagggctttcggtgtcttctcctcttgcttggggagactgaaatgagcgaaaaaacatttatcggcatagccttccttgtaggctttacggcatacttttttgatgatggccaggtagtgtcggctggtctctatggtaagccctttgtcgtccacgacaaaaaactgatagtcgtgaatgaactgttcggtcagctgaccgaaggcaatgtccttggagtggaatttcttttgaatgaactccgccaaggttcttcgggtgtagaaataggcggggtatgttccttttgcccggtctatcccgatacgtttacggagttcctcgcagacgatgtccgtcattgccagcaaggtcatctgtgtttcgagacttccctgaaacagattcttgaccgcttcggcatcaaagtctgccttgcgttccaccaaggtgtcgaatgcagcatgaatggaaagcaacaacttgtctaatttggcattgacctctactgcttcattgcttttaccgttcaatcgactctcacggggattccataagtcaggagtacaggagagtttgcaactgaactgcaccatcgaacgattgacggtaatgcgtcccatgatcggggctttgcccgacttgtcgggtctgctctttttcaggtagagcaacaccttgaatttctctatcttcatacgctttaactttatgggcaaaattacccgttatcaaagcgttctctgatacgcaaaatattgataaacagataaaaagaaaccgtatgagaaaaattcttccaataatcattacctcagtttgttcgggaaacaacaggataacggtttggtaactgaaaggtctcaatatcccatactgttttgcctatccctatctgtcgcagaacatagaaaaacaactaattcacaaccagttaccatatttccacctatgttcctcttacgcttgcttaggcttgtatttaccacatggcccggcacacatttgccacgatgtctttgagcaaaggcgttcccatcgaatccgtgtcgaagatgctgggacacaccaatatcaaaacgacgcagatttacgcccgtatcaccaataaaaagatagaacaggacatgcttaagctatcggataagctggatatattcagatctccggtgtcacaagcaaaacaatgacttgaaattgaatacaaattctataaatcaatgatatgaatacaataacagcagatgtaagcgtcatccggaataaaattcttgagattcgtggcaacagagtgatattggattatcatttggccgaactctacggtgtgcagacaaaagtgctcaaacaggccgtcaggagaaatttgcagcgcttcccggaagattttatgttcgaacttaccgaaaacgaatggacggaactggtcacaatttgtgaccggttacccgaaaccctcaaacacagttccgttgctccgatggcttttaccgagcagggagtagccatgctatcatcggtgctgcgcagtccgacagcaatagaagtgaacattgccatcatgcggactttcgttgccatgcgtcggatgattgccggttatgaagaactcaaaaagcgtatcgaagaccttgaagtaagctgtaatgtgcagttcagtgagttgtacacggccctgacggagctgttggagcaaaaagaaaaagcggaaaagcctcgtaatcccgtcggctttatcattccggggatcctctagagt

SEQ ID NO: 385 - DNA (genomic), 848 bp, PORYPHYROMONAS GINGIVALIS; double-stranded, circular
  misc_feature 1...848
  hypothetical: NO
  anti-sense: UNKNOWN
tggcccgcgaaacggtnaagncaagattaagatnaaatgtcaaaggccggtctgacgtcaggtccaatcgttttgctnatacactcgaaatgaaggaagncgatgataatgtgccggcttgtggcaatcaataccatcgaaattgtcaatgttgaggagattgaaggtttgtggtgtgaaggcgttcagtgtgcagaaactttggtcgtcacgggtgccaacaagtttgaatttgagcttgataagccttacttggatattacggttatttcagcagtatcgactttcagtggtggtaaggaaaatcttacaattgagtataaggtaagcaatacatcgaccacccagcctctgaaaccgggagcggttgtaacgctgttcagcgataaggataacaatcaagtcttctccggcggagatgttgctgttgcaacacaggagttggtcgcagaaataactaataccacacctcttacgcagataatgaaggtaaaaggagtgagctcttcccatacgggcaatttggttcttacgatactgcccaaagacggttgctactgtgagatcaaatcccctatggtcacgttaaaccatcttccttcgaattactggatcggaggaactgtaggtaagcctaacgaatggaaagagccgaacaactggaccaatgaccaagttcccgatgcggcagaggatgttgaattcgccactgaggtgaataacccgactgatccgaataatccgaagtcgggtcctgcgaaggagaacctgcatctggacgatatacaccagaatggcacagccggtcgcgttatcggcaacctgatcaatgactctgacaaagatct

SEQ ID NO: 386 - DNA (genomic), 707 bp, PORYPHYROMONAS GINGIVALIS; double-stranded, circular
  misc_feature 1...707
  hypothetical: NO
  anti-sense: UNKNOWN
tacaggattgtcataattgtcaatgagttccctcatatatccctgctcttgtataaggcttgccatataataaccgacgggatgccctccgaagagcacaagatcagccacgggtttatactccccgtcttgggaggtattcggatcgaaagcgatggacagggagtcgattcgggctaaagtattcggtgcattggccaactcttctttataggcttttacgaactcgtcgccgaagaattgcatgattttgtcgtcgtttctttttttgtcaatcagatctgctattccttcgttctggaaaagatcgaaagcattcaaaaaagaatctccggatgaaccttgataagccatttcgcgatagttgtggaaaaactcgtgagtaaataggtctacaagctcttcttcttgcatcgaaagcgcgagattcaggtcaaggaaaatagcatgatcgcgtacactggcatcgggaatagtggcaatcagaaagaggtcgttcaatagcggattggatgaccaggctcgttcgggtaagtatttttttgtcttttcatttgccctgtacaatagggtgagaaaatccgtatgcagaagaaaactgtcggcttcttctcgtttacgggcgagccgacagatattttgtctgaggacaagaaggcatattcgttattgtagcaggatgttcaagatgcttgtccgcttctgct

SEQ ID NO: 387 - DNA (genomic), 903 bp, PORYPHYROMONAS GINGIVALIS; double-stranded, circular
  misc_feature 1...903
  hypothetical: NO
  anti-sense: UNKNOWN
tccttgccgatggttgttctttcggcactttctcagattactatcgttttcaaaagcaaggctgattcgctcaaaaacgaggcatgacctgtgtgtctctgcgaacctcaagcatatacctgaaagaaacttgtggaaatctctgtttgcttggcagccatacgcctgctctttgatctttcctgaagatacaaagaatcaactcatacgagaggatactatggtctcatatagaacgttttcgatttgtatgtacttctttcgtgagattgccattacatgcttgcagcgaggaatctaccgagggagattgcctgtggccgaacgcaggccattgctgatctctcgcaagaaaacacagtctgcgaattggctgaagatcatacacaccggatgttgccaccctgtgaagtgtttgctatgtttgtctacttgaaactctgccaagagattcttaatcaaggagccaggcaacaagcgaacaactcgggcgaatgggcttatattttatactcatcagagtttgtttttgtgataggccaagggtaagattatttgcccagggcgactctgataacaaacgaaggagaggcaccgggtagttcctctcctttctattgccaaaaactgacatttaggacacgattgcctttgacagagtagatagtggcttgagaagaaaaaagaaggggtaaaatcagcaaatttgttgtacagtaaaaaatatcctttatctttgcgctgtctttcggaaagtcaatggatttttctttgcagagacattgccaagagggcctatagctcagctggtttagagcatctgccttacaagcagagggtcataggttcgaatcctattgggcccactctatggcaaacgaagcaaggatgatcgtgaaagat

SEQ ID NO: 388 - DNA (genomic), 1159 bp, PORYPHYROMONAS GINGIVALIS; double-stranded, circular
  misc_feature 1...1159
  hypothetical: NO
  anti-sense: UNKNOWN
gaactccgccgcaaaacgattcgactgactttcgctgcacctgccgttttgtcggtgccttatagctgtttttcgtcatttcaggtatgctgcctgcttgtccaatcagtttatttgatttcctttgcgtccagtgaaagcagtaatgcagagtgaatggtttagcaggaaccggtagatttctttatttctttggtatggatatgaagatatgacacacagatcgttaaccgaattcggcaatttctcttttaccttgtttcattaaaaaaccaaagatgagtatgaacatctacgtagggaatctgaactatcgggttcgcgaagaagacctcacaggtctgttgcaacagtatggcgccgtaacgagcgcaagagtaatcacagacagagaaaccggccgctcacgcggattcggcttcgtcgaaatggaagacgagaatgatgcacgccgtgccatcgaagagctgttcgatcaggaattccaaggtcgcaagctgatcgtcaaagaggcattggaacgtcccgagcgtgctcctcgccgtactttccgacacgaagatcgctattgatccttctcccacttccggcaagtcgtaccacaacgccgatacggctttccctctgagaggtcttcctctattattctaacgacacgaattacaagacaggccgcaggcacaccatcatacggtgttcacctgcggccttcttgcatctgcttgtaccatgacagcccttgtcacaaaccatcccaaccgcaactatatacggctctcaccgaacattccacccccccgaacttgccatccgccacagagcagatagcatcttccatcaatagaccatagtatcctctcatgtgagaccatagtatcctctcatatgagaccatagtatcctctcataggagaccatagtatcctctcgtatgagaccatagtatcctctcatagtagaccatagtatcctctcgtatgagaccatagtatcctctcgtatgagaccatagtatcctctcataggagaccatagtatcctctcgtatgagaccatagtatcctctcatgtgagaccatagtattctctcataggagaccatagtatcctctcgtatgagaccatagtatcctctcatgtgagaccatagtatcctctc

SEQ ID NO: 389 - DNA (genomic), 415 bp, PORYPHYROMONAS GINGIVALIS; double-stranded, circular
  misc_feature 1...415
  hypothetical: NO
  anti-sense: UNKNOWN
tacttctttcttaatgagactgataattcgttgttgggttgatgtatccattttgaacgtgatattgaaaaggctctttggactggcctgtcttatacttgattgttaattcttctcctcggattcggtgtctttgtgatccgatgtgtacaatatggcactggtagcccccatcgtaatcacatcgccatcgttcagtctgcaccattcttttttgtccagaagacgtcctccgacaaaagtacctacaagactatcgtcatcggcaatcgaataaagaaaagatccgtcttttttnggggtcactcgaagtatgcagtggtgtcgtcccatgcttggatcaccggtcaatactgcaatgtccacaaccgagtctttgttgcgacgtcctatcccgttgtcctcctttctctga

SEQ ID NO: 390 - DNA (genomic), 659 bp, PORYPHYROMONAS GINGIVALIS; double-stranded, circular
  misc_feature 1...659
  hypothetical: NO
  anti-sense: UNKNOWN
ttagaaacgaagctgatgccccatcgggctgataaaanagttnggcantcgtcagaatcatgtaggtcaatnccatcaaccaaggagaaactttcgtaaactcnacccctgcattacgctcttcgaaagtaggcagtcccattgacccgatagccatcacgacgaaagcaagtgcagcgataaacataccgatcacaattttcttaggggtggaaggctccatattacgtttcttcagaaaaccgaagatgaagagcagaagtggcgtaagagttactacgaagaacgggttgattgactggaacatttcagctcccactattgaagtgaaaccaagatcgagttttacactacttaggtcaatataatccttagcaaactgagtcagcgatactccgttttggtggaaagacatccagaagaaaataacgacaccgaaaactgcgcaaagagcaataatgcgttggcggatctcatcggctgccatcttgatttcttgcttttgatctttatgagcctcagttacggcattagctttttgatcagcgggatattgatgcttattgatgatataaaatcaggaaagaaattgccttaaagaatacggctgcaaggaaatgcatagtggaatcctggtgctgaataccttggatatattt

SEQ ID NO: 391 - DNA (genomic), 425 bp, PORYPHYROMONAS GINGIVALIS; double-stranded, circular
  misc_feature 1...425
  hypothetical: NO
  anti-sense: UNKNOWN
ggctcttctcgaacgtataaataccggccgctaccggcaaatattgctatgcgggccttgcttcacggctttggcagacagctttcccggtggtgcaacgggatttgctgacaatgctgtgctcgaagagtatttgaaagctcattccattcatgattccctcatcttgctcaaaggatcgcacggcatccacctcgaaaagataattcctctatgttgaagcaaacccttgctcaaaggcagcaacaaaatctctctgtacaacagatccagcaaatcaaactcttggagcttccggccattgagttagaagagaggatacagaaagaactggaggccaaccctgctttggaagaaggagcgtacgatgaggaggtggccggcagtgcggatggaaccgaagacaatcttatgggggacgacac

SEQ ID NO: 392 - DNA (genomic), 557 bp, PORYPHYROMONAS GINGIVALIS; double-stranded, circular
  misc_feature 1...557
  hypothetical: NO
  anti-sense: UNKNOWN
taggacactaatgtttcaaaatggcattgtgggttgcaggatctatagtaggattttcataatatgtaccaaaatcaagatcttcagcactctccacaagcccagggccaccctgaggcaccatgtagatgctcactttctcaattttgtcttttcctgcccactctcctacataatggtagtcagggttagcttgatcctgtccgtcacccgcacgagcacttcccataggcatggacaatgtcatagacatatacgacttcgccgcattgtccggatcgggcccattgccctctttactacaagaagcaaagcccaatgagagcaatgctccgaccaaaaacattttgtttaacttcataagccaaatgtttaaaaggattaatattaaattgattctaaaaacgtcgaaagaaagactataaaacacaaaacgctcaagactataaaaccggataaacttaacgatgaatcctcgttatcacatatccgaacccataatctctacaattctatactcttgcacactattctgctgaacttcacctgaacagctg

SEQ ID NO: 393 - DNA (genomic), 309 bp, PORYPHYROMONAS GINGIVALIS; double-stranded, circular
  misc_feature 1...309
  hypothetical: NO
  anti-sense: UNKNOWN
ctgaaaagcaggagattacatgttgaatgtaaatcggatggcaactcctctttcataaaagaaattgtagccaccatagaatactccgacttgcatcagcgtaccgatactctctgaataacccatctccagatagggttttctcgataccatatcccaccgggctttgaaatgtaaggcctcgtcgttggtctttaagaaaacgaaaggcaggaaattgaccagcaggcgcgaagctcggtagctggtttgaaggataaggtggttggcggctgtagcccgatagggaggcagtgtcttggaaagcag

SEQ ID NO: 394 - DNA (genomic), 474 bp, PORYPHYROMONAS GINGIVALIS; double-stranded, circular
  misc_feature 1...474
  hypothetical: NO
  anti-sense: UNKNOWN
ccgtaatggtagccaaaacatcaccagcagcaatactaccaatttgagtagtagctttaatttcatagctctgggctttcgttgaaaccatcgcacgtgctacagaacgctccaccgtaaccttggcctgattcttaatccctgcgatagcattggcctcggatacagcagcttcgatagtcaaagcatcagaaggctgcaaacaggtcatcatgattgtctcatcagtagtaccattctttttggcaatctttccagccgccgtagcaggatttgggccatcggctaccgtacctaaagcttgagcctgagtagacagttcgattacctctttgaatttagcatcaaagtctgctgcattaacatttgccaaaagggcttttgccttgcctgcgatgtcattgagcaccacatatactttaaccgtcttgccgactgcagaattaaccttgatgccttttttgggtttcaaaa

SEQ ID NO: 395 - DNA (genomic), 1003 bp, PORYPHYROMONAS GINGIVALIS; double-stranded, circular
  misc_feature 1...1003
  hypothetical: NO
  anti-sense: UNKNOWN
aaatctactagtagtttcgagaaaatctactagtggttttgaggaaatccactagtggttttggaaggatctactagtagttttgagagaatccaccgggaccggtatttacaatccttcagaggatcccgccgacaacaaactgttcctcgttttgcaacggctccatacagagaacagaggttgagtgcctgattccgccatctccgatagctgaacagatactttcgtttttaccagaaggaaaaagacaaaaggtgagattgcaagattgttgtagaaaactgctggatacctataaacctaagcgataagtccagattcagaaaaaatgcaataaaactactctgcacaatacttatcatatgcctttttatatatattcctcacttcttcttgaaaggaggctcttctattatgcaattccgtcaattgactattaatctgctgataaataattttgtgcgctggatttgggagcaatgcttcatcatatgcatctgtttcaaaatcctcttcttctacagctgcatgagcaagattcaataaatcctccttggtcatctccgttacaaccatccacttttcacctctcgtgaaataggcattctgtccttcaatttttaagtgtttcataaatatctttcctttctgaatatgcttgttcaccagcctctaagctgttcaacgtaatttcgtagttttcaattgtatttccatcaacatctcttaattctttagcagttggataaccgctataaatcttgaaatgagctccatctgcctccatctttttttcagtataaagaatgtaatcaggctttattgaacttcctattgtgttattatgcgtggaaataatcaccggcatattttcagccatttccttgataaacttgtttacttcgtttttcaaaaagatattatcaaacgaagactctggctcgtcaataatgaggatatcacacaaaatagcatctttaattttctgtaggaagttaaa

SEQ ID NO: 396 - DNA (genomic), 944 bp, PORYPHYROMONAS GINGIVALIS; double-stranded, circular
  misc_feature 1...944
  hypothetical: NO
  anti-sense: UNKNOWN
ctttcttctgatttgtggttcgacttttcctgatggatcgaacgcttcttcttcgtagggtccggggccatgcagagaaaatggtacataactaacggagctttagcgactataaaagtgcttagaaagctgtttttgatgcgtcaaccctgcaacaggcctctgtcatctatttggagcaaattcataccctttcgatctcagtcggaaaagcaaaacgggaaaaaccgaaaaaaagaatcacttcgatcgatcgctttttcatgctctgacaagtaaaaacaacttgcatggagaaagtatccttttgcgacattttgtttgccgcagagcaggcaaacaggaataagtctcggggtgccatccttttgatgttgaaatgcgatttgcgaagaagccttcgccgcattctttctctcgcggacaggcatggaatccaaatattttggagcggaatgtcttgtgaatgaaaaaaatatcggaactttgcggccgttgcgattggtctttatcacctgaaaattatttgatagggctcgtcgcattctggtaaaatccaccttatcaaactcagtatgctatgacggaaaaaactaccgtaaaaacgctgaaagatgttgtagtccgattctgcggcgactccggagatgggatgcagctgaccggaacgatattctccgacctttcggcggtgtttggcaacaccatttccactttcccggactatccggcagaaattcgtgctccacaagggacattgggcggagtatccggatttcaagtgcacatcggaaccgatctggtacgtactcccggcgatttggctgacgttctcgtagccatgaaccctgccgtctcaaagttaaccggacacacgtaagacgggactccattattattatcgactctgactctttatggcatctgattggagaaagcagaaa

SEQ ID NO: 397 - DNA (genomic), 241 bp, PORYPHYROMONAS GINGIVALIS; double-stranded, circular
  misc_feature 1...241
  hypothetical: NO
  anti-sense: UNKNOWN
ccctctttaaaactcgttggaatgccctcgactctagaggatccccccgactttcccttgattgtgacgtgtactgagaaaagtcgtatgttgtttttggtgccgaaagacggagaattaccgagcctaaaatctcaaaaactcgaaccacaaggaaaatctttacgcgcgagatttttttgcttttggctcgagttttatttttttctcgaaccatcttttttcgatccgcaattgtgct

SEQ ID NO: 398 - DNA (genomic), 3624 bp, PORYPHYROMONAS GINGIVALIS; double-stranded, circular
  misc_feature 1...3624
  hypothetical: NO
  anti-sense: UNKNOWN
agaagagaatactacagatcatcatactgctatcggtatcgatcgttcagggatttgctgccggagtggaaagactgtcggtgccaagcgcatcgatgaataaggagatccctgtactcgtagtgcttccggatatagccttggcgagcgagggcggagattgccccgtggtgtacctgctgcatggctatggcggaaatgccgaaacatggctaaccgttaagccggacctcccgcagatagcagatcaaaaagggatcatcttcgtttgtcccgatgcacagaatagctggtattgggatagcccggtcgattcggcctttcgctacgagacgtttgtcgcttccgagttggtcggatatatagacttgcactacaaaaccattgcagagagaaaggggcgagctatcgccggactcagcatgggtgggcacggcgccttatggattgcctttcggcatcaggacgcgttcggagcctgtgggagcatgagcggttgtgcggatattcgtccctttccgaacaactgggagataagcagacggcttggctctttggccgagaatccgaagctatgggacgagtacactgtgatcaacaacctcgacagcttgagaggggccgcacttgctatcctaatagattgcggagtggaggatttctttctggatgtcaacaaagagctgcatgcctcacttctggcaaagcaaatcgatcatgattttaccatccgcccgggagggcacaacagagcttattggcgtaatgccatagattatcagatcttatttttcgaaaaatacttccgccggcacatcgaatctcaggtagaataagatcaaaaaagaatatcggcaaaggccgctacctctcaattcgcgagagccatgcacttggtgccggggagcaggagaagatcgtccaaagaataaacacgccgtcctgccactgagatggacggccggatcggtagcaaagaatccgctctgagcaaagcggcagcaaccaactcggtacaatacagctcggcatcggaggccgaatcaaaagcaaaatcgaaaggaacttgacgttcgcgatagtcgagagcagctctgacaaagtgcgacaggacggaatcaggaagatggagacgatagatacctgcacgccgcgaatgtgcaaggaatgacgaaagggattccaaggcgactcctccatgtccactgctcggatcttcttcggtatggactaccgagcaactatccgtaccggcataaagaacgatgccgatatggctatattcttgtgccgaagaggcctttttcctgaaaagaccggaataccacgaagtgcctaagcgacagatgaggtcgccatcgcgcaattccgttccttcggggaaggcaggtacaaaaaacctttctttcctgccctgcgagcatgcactcagacagagcagaaaagaaagggagagaatgcaccgggtaacgaatgcattaagacgcaaaactgtaaatccgaagggatgcttatttcccgatcgcttcatcgacaagccatttgttgtcgatattcaccacatgaaccgtggttgtatcatcttcgaaatccagataggtgacccaagcttccttctccacaatactatccttgataaaggtaaacttgtagtttggtttggcctctccgcccaaagcaccatacagatcgacaagcttattggtgcgttccgtgcaatacttcttagcctcttcatatttctgtttggccatgttctccgagaagttctttacagcatctttcgggccggacgatgaacagccggccatcaaggcagcggcaaacaatgccgctccgattttccatcttttcatattagaatttttactttttaagtatcagttgcttagcaaagatagcgaatatccctatctcctcattcgtgcaggtgacaataatcgtccgaaaaaggccgaaaggagagacaaggccagtaaaatgtggagccggaatcaggagaaacatggttccaaaaaatctgaaaaatcgaaccaaaacaaaaacttttacgttcgggaatttttttcttttggcgcgagttccaaaaaattcccgaaccatgtttttagggatgtgttttgattgtttttcggcgcatgaaaagaaaaaatggtcagcttcccccttcctcttcgctctttttcatttcccccaagatacaacagggggcgcagagttttcggatcggacggattcgatcgggaactaaatccggccgattctgtttaaccatatgagacgaaaacctgtcgaatggtgccaatatgcaatcatgaatgtaccctttgaacagaatcatcaacttaaaaacagtcaattatgaagacaaaaagactttttctactggcgatcattgcactatgcagcattcatgcatcaatggggcttgacctccaaaaacgagtaaaagggaatgagcaattcgcctctgaagagcgtttggcagagcctttcacagcctttcggcatcaggcagcattgatattcagatcgaatactccccatacaggcacccctccgaatagaagccgagtcgaacatcataccactaatcaatacaacggtaaagaaaggtgtcctgaacatcgaattcgaaaaaaaacgttccatatcgcctaatgctgcagtgcgagttatcgtcagtgtgccggaaatacaatcagtcacactgggcggtagtggcaatttgattttcggttccggtttcaaccagcccaccctgaaagtaaccattaacggtagcggcagtataaacttcatcgatacaaaagcggaacaactggacatcgtagtcaatggtagcggtgaccttcgcggcagcatttttgctcataaggatatacgcatgaacctgaaaggatccggcaatatcactctttccatagacgaaaccaagacgattcaagctaatatgaaaggaagtggaggtattaagctgacaggaaaagcttcgaacacgatactgagaagttcgggaagcgggatgttcgactgccaaagcctgacgactgaccatgccgacataaaaatgagcggaagcggaggcggccgcctcagtgtaacgaagaaaatcagcgtcaatctatcaggatccgccggtttcacctgccatggaaaggctaaaataggttcttataaaataggacgctcttcttcattcagtatgcaaccgtaagcggttccacatcttaagccaataaatacttccctttttcgtaaacgaagaaaagacagaagaaccgagaagagtcgagttgcagcttttgcttcccgactcttcttttttagctctcaatgcgattgaacggaggagtgatttccctctttcgaacgtaatgtttttgcgcccattcgagatagagagttcgagaaaaaacggtttgagatgtaacatttcgggggcttgtccgtcttactgatagaacgactaacaagaaaccaatcaatcatgtggacaaaaagactccttttcctcgtgctcgcggcagcaagtatcagttttgcatctgcccaaataatctcatggaaacgcatcaagggtaacggtaaagttcagacagaagagcggcgtataggtcaatt

SEQ ID NO: 399 - DNA (genomic), 815 bp, PORYPHYROMONAS GINGIVALIS; double-stranded, circular
  misc_feature 1...815
  hypothetical: NO
  anti-sense: UNKNOWN
caaaacgccattgccnatagtaccacctncatattcgnttgctgtcatgactgtccaaacattgngggcatcttcatcctttcccgttacaataaaatcgcaatgcgagacatcgaagtcataaggcaccaaagaccccaaagaccctaacttttggtaagtagcaccaccgtctttggaaccgatacagcctgacatcatcaaaataaatacgagagaaatccaacatcacatagatccatccattgtctgccacagccatcttgtaataaaaatcctctgaatatcctgatagggtggacatcgtctcgatcaatacatcgtctccaccaatatccatctgggccttggccagagggctaaataaaactatggcaaaagtcgccagcagcagtctgagtgcaatttttaatttcataattcttggcatttttatgagtgaaacatttcttgttcatatcaccaaaatacttacctggcataaacgagcgactcacaataatcggctcgggaacggctactccagcttcgtgagcagcgtactgcctacgagcttgcccttcttgtcgtagctctcactcttgacgcatccgacatccttggacatccattccacggcactcatctgtaccgtaatcatactttccatgacgatcgaatagctgatcttgtagcattcgaaagtcccggccggagtggtaatcctctcgatgccctgcaccttgcgtccgatggttcgcagagtaatcgggggcaacgggaaatcggccgcttcggccgtaatcgtcacttctgcatcgggcagggactgaccc

SEQ ID NO: 400 - DNA (genomic), 843 bp, PORYPHYROMONAS GINGIVALIS; double-stranded, circular
  misc_feature 1...843
  hypothetical: NO
  anti-sense: UNKNOWN
gaatttaatgtgctatatcatgggctaggcggcaatctgtttctcctgcatagcctccgacacctgtaccatcgtgaagatgtcgtttcgatcgacagctttattcaggcttgcttacgtgagtcacttgcagaatatccaaaagtcgatcatgatcggcaaagacttgtctcatcatcggttgaggcacgaatggtgccagttcctccggcttatctcgtctcggaatacgcanaaggactccatccaaataaggctccaagccgaacagtccgatatagccggtcgatggggcaaggctaccataataataatcggggtagccatccaaatcataatagcgagaatatggcatgcctttcgtctccagcaaatcggctttgtcctcatagcccatcgagcggaacatggccgccacctcttcggtgcgctcacaatgtgctcggaaaggtatgtctgcgactataagcgactccattcgctccttgatccgcacgatctctccgggtgtgatcatatgagcattcttgatctgacaatagtaaccgttggacaatgaatgttcgatgaaaagtttgctcccgggcaatatgtctgcaacagccttgcttaatatgaagctgagcgttcggacgtaagttcgcatacccgattcgtccgaaaaagaagcgaacaggacatcggatggctcatataatctgaaaccaagatctcgtgtacaatgattgacttgtgcattgaaaggacgaaagcccaaatcgtcttgaaagtactctgccactcgctctaaagatatgccatgtggaaactcttcgtagcgatcgagattgtcacagtagatgc

SEQ ID NO: 401 - DNA (genomic), 10684 bp, PORYPHYROMONAS GINGIVALIS; double-stranded, circular
  misc_feature 1...10684
  hypothetical: NO
  anti-sense: UNKNOWN
ccgtacggcctcactgatcaggaaggcttctcctttcggattgtacagagcttgtgggatgaaattggacaaactccatgtcgcgcacctcacagccggcaagatagcagagggcaatcccatctccgagggtaccctgcggattggtggatcttcggtagatggcagccgatcccccggtggccatcaccgtatgcttgccatagaaaacgacttcacgcccatgtccccaatcccatgtacgtacgccacggcaaccgaggtcgtctatcagcaattcgaccgcttggtgattgacaaatatctctattgcagaagtttgcagcacgctatcgatcataaagctcgtgagcatcctaccggtagaatcaccccctgcatgcagaatccgcttgtggtggtgtccgccttcaagccccagagccaataggccatcagcttccgtatcgaaacgcatcccccaacggatcaactcatcgatccgctccggagcctcttcggcaagtacccttacggcttcatcctcacaaaggccccgacctgcttcgaccgtatcgttatagtggttgtccggtgcatcgtcagcagcagtaaccgctgcgactcccccttgtgcaaagtacgaattgctctcatggatgtcagctttggttatcagagctacccgaccatgcttcgaagccttgaaagccgtatagaggccggcaaggccgcctccgactacgatataatcaaaccgattcattccggacaaattgatatgcccgcaaagataaagcaaataaaaggttatccgaaggcagggagagatggagggtaagctaaaggtctaaaggcggaagcaattaacacgattacgaataaaagaagaagtctccgagctgtgcgttgcaacaacattactaaatctgaaagctattccctgtgaaaaaagggagaccacgaaaataataatctgctcaaaaatcatgcgccaaaaaagttttcaacaacgaagacgagtttggaacgattccaaataagtatctgtagagaggagaaaagcaaggtaaaagtggagggaaaaggaactgccatagatcgaaattccacttaaaacaagccgtacaacgatttgtatataaagcgttttcaatttgtatacaaatcgttttcattttatatttaaatcgtttttgataaatatatagatcgtaagtgattttgtatataaatcgcaggctcaaaaaagccttttccgatgctgatataaaagaagcacccgccgagttctacggagaactccgacgggtgcagtccggatatgtatgtggtagggcctatgccaagatgctatccttttgcatgtgattcgatgtagctgcacgattcctctctacaatctcggatcggatcgaggactgtcgctgctgtgctgaaggatccgaataggagcctgttcgggcttgatgtcaggtgatggggcatagtcggtagtttatggatgtgtggcatattaatataatactctcttttttcaattaattgctcacttccaatacacggggaaattcactgttcggagcaatgcttttcggaagacaaaattagtcaattctttttctcttgccaatgactgctgtgcttatacttgaaaaacggaatgtacaagagcgcaggggaaccacatcaaaatccgagtaacatcttcgttgttgaaattttttttcgctcgtgtttttgggcctatgtatcatcctttttaggtacatatggaggaaaaaagaataaacaaaatgcaagcattaaattgcggcagagaagagatagagcgaaaggcttttcgttccatttctttcggttgcgtacttgttttattatgtttgctcctatgaagcagatagaagatatatccgagtttcgctcttcgcctgagcttgtggacaaactgtataagcatggcatcctcaaggtctacaaggccggtagcgttatcctcaatgagaatgcacatgtccggtccattcctatcgttatcaaaggggtcatgagggtaatccgtaccgaagaggatggcagagaaatcctgctctactatatcaaggcaggcgaaagctgtatcatgtcttttcttgggggcctgcacaatgagacaagcaaggtgaaggtggagatcgaagacgatgccgagattcttttcttgcccgtcgataaggtttccctctttatgaaggagcatcccgaatggctcaactacatctttccgctcctatcacaagcgattcgaggagctattagatacggtgaatgccattgctttcaagaagatggacgaacgcctactggccctcattcaaaagaaagccgaactcgtggagggtaatactatacagatcacgcacgaacaactggctaatgaattgggaccagccagggccgtagtatcaaggctgctcaaacaattggaagaatccggcatcgttcgcttagggcgtaacaaaatcacccttatgtgaccaaagtagctgtacgccgttccggatatgatgacctttgcctcatcataaaaccggagactgtatgcttatagcaggttacttggcatctattttaatcggcctgtcactcggccttatcggtggcggagggagtatcctcaccgttcccgtactcgtatatctgatgggcatagaccctgtcttgggcacggcctattcgctttttatcgtgggagctaccagtgtggtcgggagtatctcatacttccgccgttcgctggtggacgttcgtactgcagtgcttttcggcctgccatcgatcttcgccgtattcctgacgagagcttatctggtaccggcgattccggagtgtgtattgagtccgggcagttttgcgatcgaccggaacatgctcctgatgctcttgtttgccgtactgatgcttacggcatccgtcagcatgatcagaccggctaaaatgcaggagaaagcatcacagagaccccctaagccgaaacagccccgttatgccctgatcctccttgagggaattgtggtcggtacgctcacagggcttgtcggtgccggaggaggcttcttgatcatccctgccttagtcttcctcggaggcctaccgatgaaacaagctatcggcacctcacttgtaatcatatcagccaaatcgctcttgggatttctgggagagaataatccggcaggtctcgactgggggcttctcctctcggtaacagcttttgccatcatcgggatattcatcggaatgaaactctcccaatatattgacggagacaaactcaagccggcattcggctggttcgtcttcgtcatggggctatacatcattctcaaagagaccatactcgtatacttcgcgtcattgtgtgactaaagtagctgtacgagccggaaaggtggttgatctttgcactgacagacaagcaataataacattcgacaaatatgaaagtagaacagatttacacaggctgcttagcccagggtgcatactacatcacttcgatgggagaggctgccatcatcgacccactgcgtgaaatcacgccctacctcgaacgtctcaaacgcgacggggtaaagctcaaatacatattggagacgcatttccatgccgactttgtgagcggacaccttgatctgagccgtgccacaggtgctcccattgtttatggacctacggctaagcccggattcgatgcgatagtagctgaggataatcagatcttcgagttgggtaatgtaaagatccgagtgcttcatacacccggacatacgatggaaagctcttgcttcctgcttatcgacgaaaacggacgcgaggcggctctcttcagtggcgacacactcttcctgggggatgtcggccgtcctgacctggcgcagaaagcagcaaacttgacacaggaagagctggccggcctgctctatgatagtctctacaccaagatcctccccttgtcggacgacatcatcgtatatccggctcacggtgccggatcggcctgcggcaagaatatgatgcaggagacagtggacagtcttggcaaccaaaagcgcgttaattacgctcttaatcaaccgggcaaggaagcgtttatagcatctgtgatagagggcttgctgccaccgccggcatatttcgggggcaatgtagccatgaacaagatgggatatgacagcatcgacaacgtgatggagcgcggactctccgccctctcggccacggacttcgaagcgatagccaaaacgtccgatgctctggtgctcgatacgagagctcccggtgtgttcgcccaaggcttcattcctcgctcgatcaacatcggtttggatggggatttcgccccttgggtcggtacgatgatcgtagacgtgaagcaacctctgttgcttgtggcagatccgggacgtgagcaggaagtgatcacaaggctcagccgtgtaggattcgatcaggtactgggctatttggatggcggattcgatacatggaatgcctcgggtaaagaaatcgaccacgtcgaatgcattacggccaacgaatttgccgaacgattctgccctgaagagagtctcgtgttcgatgtgcgcaaggagagcgaatacgcagctgagcacgtggaaggagcttatagccgtccgctcgcctatatcaatgactggatacaggatattccccgagaccgccacttctatctgcattgtataggtggataccgcagtatgattgcatccagcatcctactctcgcgaggctatcgtaatttcacggacatcgaaggcggattcgcaagcattgcgcagaccggtgttcccaaaacggactatgtatgtcaaagcaaagtgtcaaaaaaataatatcgttttccttaaccatcattatcgcaattgtcatgttaggattactgaaaaatctattctcgcagtctgacgataaggctctgagtgaggctattcgcaacggcgcctttctggtcgatgtgcgtacgccgggtgaatttgcatcaggcagtgtagccggagccgtgaatattccgctggaccggatagcatctcgcctgaatgaactcaagaataagaagaccatcatcgtcttctgtcgcagcggcaacagaagcagccaggccaagagcattctcgaacgcaacggcttctccaacgtactcgatggaggcacctgggggcatgtagcctctctgaaaggcgatcagtgataacgaagtctgagaaagacttcgaccgttacaactctttctctattaagaaggattggtttttgaatttttgtctttccgaagacaagaatatcatcataaaaccaatccttttttacatcatataaatgaatcctattctcttttactctgctgtctatagcatgcaaaaggtctcaaaatccgatattaccgctttctataccctataaatcacatccaaagcagggcaattgcatttgaaatataggtctgatgatgttccgtccggaataaacacgaattaatgtgttagagatcctaattgtagaaggaagagaccaaggatacggagtacaacctttcaaatacgatagccccctgccgaaggggccggtctcttcggggaattttctgtagtctgtgttgctcttactattggaaattacaatcatgggtgcctttctattataagaaatgagtcctgatcttcccaaacaagggggaaaaatgaattttgaagacgcaaaacagggaaaacttccaagattattttcatttcaccttaattggccataatgtactggtaattagcatgttgtaacgagcaccgtacgcctacgccggtctcctgcaccgtgcaggagagcatcgtacgcctacgatcgtaagtgtttcgtaccggcttttcaacacttcttcgtattcctctgcataatcttcaatctcgtaccagaggtatcacctgagagcgtagagaggaaaacgatcaggaataaaaagtcaagaggataaacttctttgctctctatccgtgggtccgagaccatgaagagattttccgatagagactgaatacatgactgacggctcattcaacgactataaaatttatagaacgctgttttgaatgcctctgccctgacatccaaagtgatgtccttttcgagatcagccttttcctaatttcttttcgattttttttctccgggatgtaaaagacatggattgcatcaatgggcacgaacatgtcgatgagatcgaatggatccgaattctctcgtttttccgatatgtatttggatttgctttgctattagacagtctaagaccctttttaggcttttttgccgaaaaaattacggagataatatgctacttttgtggcattgtacaaacaaaagattaccaaataatggatatgatcaacagacgcatacgcgtacgtttcgctccgagtcctaccggaccgttgcatataggaggggtacgtacggctctatacaactatcttttcgcccgtcagcatggaggtgatatgatcctgcgcatcgaggatacggacagcaacagatttgtgcccggtgccgaagcgtatataatagaggcattggaatggctcggcatcaaattcgatgaaggtgtaggctatggtggccgatttggcccttacaggcagagcgaaaggcgcgatatttatcgcacatatgttcgccaactactggattcgggacgggcatatatcgccttcgatacgccggaggaactggaagctcggcgagccgaggtgcccaacttccaatacgatgccactactcgtgggcaaatgcgcaactctctgacactgcctgccgaagaagtggagcgtctcgttgccgaggggacgcagtatgtggttcgtttcctcgtggagccgaatttggacgtagaagtgaacgacctgattcgcggacgagtggtgatcaactcttccatcctcgatgacaaggtgctgtataaaagtgccgacgacttgcccacctaccatctggccaatatcgtggacgaccatctgatggaagtgagccatgtgatacgtggtgaggagtggttgcccagtgcaccacttcatgtactgctctatcgtgctttcggttgggaagatacgatgccgagatttgcccatttggcactgctgctgaagcccgaaggaaacggtaagctgagcaaacgcgatggcgatcgtttgggatttcccgtatttccgctggagtggaaagatccccaaacgggagatatatccaaaggttatcgtgaaagcggttatctgcccgaagcagtggtaaacttcctcgcgcttctgggctggaatccgggcaatgatcaggatgtcatgagcatggacgaattgatccgactgttcgacatcgaaaaatgcagcaaggccggagccaagttcgactacgagaaaggacgctggttcaatcaccaatatatccagcgtaaggacaatgcggagttggccgaactcttccgtcccatccttcgcgaaaatggagtagtggctaccgacgagaaaacagctcatgtaatctccctcgtcaaggaacgtgtaaactttatcggagagctatgggagcaagccggattcttcttcatcgcaccgctatcctatgatgaaaaaacagtgaaaaaacgctggaaagaagatacggccaagcagttgggcgaactagccgaattgctggactctcaccgatcgtttgcagccgaagcaaccgaacccactgtgaagaattggatcgagaccaatggctatcacctcggcaatatcatgaatgccactcggttggcactcgtgggcgagagcaagggacctcatatcttcgacatcatggaagtgctcgggcgtgaagagaccgttggacgcatacgtcgtgccatcgaagtcttaggctgacagcaataatttttttcgaaatatatgcgattccttttcagcctgatcggattggtctattcttcgctgatcaaacttgccgttccgttcaatcccaaagcccgcatgatggttcgtgggcgatggaaggtgtggcgtcagctgcgtgagggcatagtgccgggcgggcgctatatatggtttcatgcagcttctttgggcgaattcgagcaggggagaccgatgatagaacgcatccgaagcgaatatccggactataggatcgtgcttaccttcttcagcccctcgggatatgaggtacgtaagaattacgaaggtgccgacgtgatcgtgtatttgccggcagatcgtttgcccgagtgcgtaagtttctggatctggtcaagcctgagatggctattttcatcaaatacgacttctggccctgtttcctgacagaattggagcgtaggcagatacctacctatctggtttcatccatcttccgaccgtcacagctgtttttccgctggtatggaggagcatacaaacgtttgctacactgctttacacacatttttgttcaggacaaggcttcacgcctgctacttgaaaagcatgggatagaccatgtatccgtagcgggagatacgcgcttcgaccgggtgatctccgtatatgaagctcggaaatcgcttccgctgatagagcgttttgctgcttccgtgccggaagacggtttggtcattgtgggcggtagcagttggcctcccgacgaagagatactcgtacgctacttcaatcgaaatcccaagatcaaactcatattggcaccgcacgaaatcgacaaggaacatttgcttcagatcatatcgcatatacgacggcctttcatacgactttcggaagctacggaaagcgatattgcccggcaggattgtctgattgtagacagcttcggtctcctatcctccatttatcgctacggtcaagtagcttttatcggaggaggattcggcaaaggcattcacaatacacccgaggccgcagtctatggtataccggttattttcggaccacgatatgagaaattcaaggaagcccgtgaattgatagatgtcggcggaggcttctccgtatcctcagcagaggaatttggcaacctgatcaagcgaatacaaacggacaaggcctatagggacgccgcatcccgcgcagcagcagactacatcagatccaatgccggtgcaacgggatacatcgtgcaccgaatcatgaaataggctcaattggggggatatgtgaccgaaatcattcattaccctcgctccctgcctccaatccgaatagaacacacacaaagagatatgaatatttgtaagcggacgatacgaacgaacagctggtgggcttttgcctatcgtatggcattggcttatttccttttcggtattgcccgtggactgttctacctcttcaactatcgcttttttgccgacatgactgccgagcaggtatggcgtgcatggatgggagggcttaggttcgacacggcttccgttttgtatttgaatgccctttttattctgttgagctttctgccgttcaggtttcgtgccaagcgatcttatcgaatcctgaccgactggacctttttcgtgccaaatgctttggggctggcggcaggtctggccgattgtatttactatccatacaccttgaaacgaacatcctcgacggttttctctgaattcagccatgagggcggaggactgatatggcatcttctcctgaattactggtatatgagcctgctggctatagtcctcgttgctgctatggtatggctatatcatcgggtcaagccggtacgcacctatgccgaagcgaaagacagcctacattattatacagttcacgttggtagccctcgttgccgctattgcatttatcgtatggggtatacgagnaggcagttttgccaagtcgtggcgtcctatgacaatgagttatgccaatctgtcggtggacaaagtggaacatagggctttggtactgaacacgccctacagcatcattcgtaccattggcaaacagggattggaggaaaagcgtttttatgcctccgaaaaggagttggagcaagtattcaatcccattcatcatttggcgacggacacgacagctcgtttcagtcagttgcgtggacgcaacgtgatggtgataatcatcgaaagctttgctcgccaatacgtaggacggctgaaccaagacattcccgattacaaaggatatacaccctgcttcgactcgatttcacaaaagggttaccttttcgaacaggcttttgccaacgggcgcaagagtatcgatgccatgccgtccatattaagctcgttgccttccctccgctcacacttcattacatctcactattcgggcaatgagattgaaggattggggacggctctcgggcggatcggttatcaatccattttcttgcatggtgcaccaaacggatcaatgggcttcgatgcttttgtcaaacaagccggctacaaacgttatttcggcaagacagagtatgcccacgatgaagatttcgatggcgtatggggcatctgggacgagcccgttcttactacatgccgtggacgaactcagccgtatgaaacaacctttcgtaggtacgctgttcacgctttccagtcatgagcctttccatattccaagccatcgcgaaggtctttttccaacgaaggcgaaccgttggtgca

SEQ ID NO: 402 - DNA (genomic), 711 bp, PORYPHYROMONAS GINGIVALIS; double-stranded, circular
  misc_feature 1...711
  hypothetical: NO
  anti-sense: UNKNOWN
tgccacagcaaagttcgtcgttatactgatagaggggatattggcactgttggtagccgctgttgtaaaccaaatagcctatacgatagaggtactcctctaccccgctgtcttggaagcatcgtactatgcgccttatatctggcagacatcagcaggctatgggtggttttcatccggattcttggatctctactggccgggggccgtcattctgttcaatgtactgtcagcaggtatttacttcgccgttagtgtccgaaaactcaccatggctaccgtggctttcctcctgactatgggaggtgaaacgattttgttcggcatactgacatccaatctgaacctgtacggagaagatcttttcactgctcttttcttcggcagtatcggcttgtgcctattcgttttatcctttatcaaccttcaaagacgacaactgaaatgactgctatacttcaagcacaatccatattcctccaaatatcggacacgatcaaggacaggattctctccggcgaatattcggccgacgaaagggtaccatctgtccgcgaattggccgaacagatgggaggtcaatcctaacacagcgatgcgagctgtcgaacgcttgcaaatggaaggtatgatctataacaagcgcggactcggctactttgtcagccccaacgctcgcgaagagatccttgcctctcgacgcaagaattc

SEQ ID NO: 403 - DNA (genomic), 422 bp, PORYPHYROMONAS GINGIVALIS; double-stranded, circular
  misc_feature 1...422
  hypothetical: NO
  anti-sense: UNKNOWN
ggatctcctcggcggataaaatctttccggtagccgaagaatcggctgccgattcagtctctacttccgacgtagcgatcgaggaagagtccaccggcaagaatacggaccggcgaatggaggtatcctggttttgtgcttgcaatgacagcaacgagccgatcgacagaaaaaggatcaggggtaaaaccgcaatatggcgtagtacaggcgttctcatcttttcaaggttttagtgctgtcaatctgttcgattatgctgcaaacacgttcgtacacggagtccatcgccgcatgctcattgctctcaggagcatatcgggcaaaatttcgcaaggtctcgatcagttgcataaagctcccttcgataagaagttttcaggcaccatgaacccggcttgaagcaaagttcgttccgggcg

SEQ ID NO: 404 - DNA (genomic), 2073 bp, PORYPHYROMONAS GINGIVALIS; double-stranded, circular
  misc_feature 1...2073
  hypothetical: NO
  anti-sense: UNKNOWN
cgcagataagtttgcagccaaaatgctcgatcgtatgcaagttcgggtgccccaagcaccggttcgcgattgggctctttcattcgaatatcgaaagtcgtaaccacctctccccctatatagtccttgcgggagacatatatgcctcgtttgaggcgaatatgatctaactgaaaactgggaattttttccatctccatatcgggattgtcttatttctacattgcatcgaatactctttcgagaatagaaaaggtagccggagaagccttgcgccagaagtccatatactccgcaaagttatcccgaccttcgccggcaatatcgctgataatacgcacggcgatgaacgggactctgtatatatatgccacctgagccaacgcagcagactccatatccacggcaacggcatcgggaaaagtacgacgaacaaagtcctgctcctccgatgacgacaagaaacgatcgccacaacagaccacaccctctcggacaggtaccggaagcgaacgaaaaagggcgagaagatcctccgaaacgggataataaaggggaaaaccctgcacctgcccccaagcaatatcggctccgcacgaaacatcgtgatagcagacagccgtggacactaccgtatcatggatagcgacattccgccccaatcctccgctcacgcctatattgatgaggtagtcgggacgatagcggcagatcagttctccggcacagacagcggcagccaccttccctattccgctcagggcatatatgacgcgatgtcctccgacaattccgacaacggcacggaaaaccgcatcccgtatttcttccttgttttcgaggatgtccggtagcaggcgaaactctttctccatggctactaccacaccgatagtcttgttcattgctgtacagcttctattcttcgatcggccaaaggtatatcatctgtcacaatatgattgtatgcagactcgtcagccgacacatacacgacagccctctttataatcgttcgagggcgacgtgtgctgaaaaagggccggaagtcggagaggttaatccgatccttgtgttatagaaagagtcggtattgtaccggactctttccgtttaatcttgccttaattctatcgttgtatgaccaatccggggttaaagagcaataatcacaaaactattcgacgaggatttcgggatgccacgatgatgaagtcaggataataaagcaatcggggcaacatcggagagagagaaaacctctcgccatgctgccccgatctgtttgttagtactcgcgcgtcgttattgaacgatcactctttctgtaatatcaccgatctgcaagaggaaaacgcccttgagatggctgatatctatctgctggaagatgttattaagcgtaactctgtaaacaatctgtccgttcatatctataagagatgccactttgcctaccatttctgccggtatctctatcgtcaaatcttttgatgtgggtatgggatagacatggaagcctttggtgtcgacttctcctacggcattgctcttcttcatcagggctgtcacttctgtatctttctcaagaaggaattcatacggagcttcgatattctctccgttcaccattaccttgtccacttcgtaaccttcggcagggatgggatgtattttaatacgacggcctgccactaatgtggaaccgctgttcaggggctgcccatcggccgttagctttatctctccattttcgggctggatgaccactacggaatatacagagataggttcataaatcgcttccacttcatttgtagattctttgactactacatgagtataactgtttttgaagggtagtcctgaaaaatccacataatctttaagtccgaaatatactaaatctgctatggaaggctttgggaagaatgtctctgaagcgagcatttctttgtcgtactcatagtagtaccagaaatcgtcacgcccggctttgacaatatccattccttcactgtcgtattcgtatatcaattcaaattcgttcaaacctgtactggccggggatcc

SEQ ID NO: 405 - DNA (genomic), 269 bp, PORYPHYROMONAS GINGIVALIS; double-stranded, circular
  misc_feature 1...269
  hypothetical: NO
  anti-sense: UNKNOWN
ggatctcttgataaattggcaattccaatttatcaagagatcccctctttttttgcgtgagagatacttcatcacagatggatttgcttatttgctcacgtctataattcaacccaacctgtttttcattgggtttgtcgctcaaaaagcgaatagatcccctcgtaaaatagttggcgtgtactgaatgaaaaacatatagagaccattgcacaataacccttccatctcctcatatngatcaaaacagacacatgcattgattcgga

SEQ ID NO: 406 - DNA (genomic), 612 bp, PORYPHYROMONAS GINGIVALIS; double-stranded, circular
  misc_feature 1...612
  hypothetical: NO
  anti-sense: UNKNOWN
tagaggttccccggccaactcatcggcttgtgcgtggacgacgctaacgaatccgaccagaccgaagctcgtatggagcgttggatcgctgccatgggcttgtaattaatgttctctaagagccggagatcgagatcagagggaaactgcttagcgcgaaataaaagcgtatttgtcatcaaagcttactcctcttctcggccttcggctctctcgttaccactcttttcctcttccccttctttccgttatttattcgactcctgacgatggacacgcaaacactcaatagcgatctgcgcgtattcatgcaccatatatacgagtttgaaaaaggtgtgcgaagcatggtactcgccacactggctaacgacgacatcccatatgcggaagaacggctgcgaagccggcagatcccctatttcgcccagcctactccgaatacggagcgtaccaatctctttttcggctgcaaggagtgtatgggaggctatccgtcttttcgtgagtggacgcttctctgaacaagcctgacttccggaggaagaattcatcatcggggctatgctcggatacgatatttgcagacagtgcgaacgctattggtcgccg

SEQ ID NO: 407 - DNA (genomic), 678 bp, PORYPHYROMONAS GINGIVALIS; double-stranded, circular
  misc_feature 1...678
  hypothetical: NO
  anti-sense: UNKNOWN
tcccccagcttccaatgtacgaggttccagcccttcgggcagaacgatccgttgtttgttctcttgagcacgtctgataacgtcttgaatgagatccatggataataccttatagttattatagttattgtaatgatgatcttgaaaagaaaggcgagcagaaataacgccttgtttgcagtcgcaaagatagttaaaaacacgggcaataagagagatacattcaaaatactttggaaatggaagtatagctttggcagggctgtacttccattctccccattgcattaatatccttttttgctgttctatctagtacgtgacgaaagaggatgacgcaacccctctaccgacttcagatagacttcggctgcaccgattctcagctccatcctgatacggacaggtattctattggcatcattcgtgagccatatggtaatagcctttttgggattcttgaatgtttcggattcgtttatgagcatggatacccgatgagtatgatagttgataccctttttcgttttttgtacttcagaactttcgtattgaaagaaacagtcgatcccctttttccctgcaaatattcttaccggtatgcgctcttttgtactctttgaccagtcttgtcgagcgaagatagagtatggctcctatcatatccagagatatttg

SEQ ID NO: 408 - DNA (genomic), 2783 bp, PORYPHYROMONAS GINGIVALIS; double-stranded, circular
  misc_feature 1...2783
  hypothetical: NO
  anti-sense: UNKNOWN
ccgtcactgatgatgctgatctgctctatctgtccagcaggttgtttgcaagattgtcttcccgtacttccttacgagcacatggttgcgactgataccgatgaaagctcctggctcggtaactaccaaatcgaatatctctcccctctcttgcaattgtcttttttgctgctcacgcaggatttcgctctctttctttatcgggaaattgtctgcacttgagaccactgtctgccgcatagcctctcgaagagtctgtttggccgtttccgaagagagaaagcccagccgtagaagattgtccttggcgcttttccgagcctcggaggtcggtaatgatgcgatgtgagtggcatagacagtggcggcaacttcgtcaatagcctctatgtccaccttttcgagcagtttgcggtagtactgctccatgccatggattgtctccgagagagctgagaagttttcggtgtcgcgatggagcgcgagtgtgatcttgcgtttgagtccctctttcttgtcccggctcatgctccttgaaccatctgcacagaacgtaataccgaggaaactgaaagagctttttatgctcgataccacaaagtccctattcagcttcagccctttgcggtatttcaaatgttcgctcaggtcttggagagcatttagcggatctactttctccggcaagaagagtagcaggtcgtcggcatagcggataaattcggttgttatatgcccggcgatgtagcgatccgtgtcttccaagtagaggttggaaagcagaggggccagagggcttccctgtgggatgccggaggatgcacgagcatattgctgcttccggtccacgactccggacttcatccagaggctcaacatacgggtaaggaagggatcttcggttgttctttggactttctgcaatagagaggggacagggatagaatcgaagaagttgtcaatatcgcagcgcaccactgtatggttctcatccagagaatccagcagatgctgcactctacgaacggcagccacagctcccttccccttgcgataggcatagctctgtgcaatggataaagactcggtgatcggatagagtatgccggcaaggcttctctgcaagtggagatccactgccgaagggatatgtagctgtcggtaagagccatcccccttgggtatgttcacagagtgatagggctgcggtatatagctgcaaatacgtagggcttccaacaaatcttgtcgctccgcttctgccatgggaaggtcacgatccgcagccagcgaagagagccacttgcgatacaaggtatcgttgcccggagtgctctctatctgaccattccccacgattgtatgattgcctatatgcacccaatgcgccattgagagcataagggctgctacgggatcgtagggaacacgatagaagagctgacccaatatgccggacatgtcgtactgtctgttttccttgatagtcgccttgcgtggcatacttatctgggagtaaatcagcccatcatggtcggggaaaatatatcgctccacagatgtctctcccctgctcaggtattgcgtatatagctcatacagacgccgtgagagtctattcatgagacgcgagtagggtatttcggcggacagtatttgatctaccttgatactggccggagacagaaagcgtacagagaggatttcaccccaacggattgcttgccgagaaaagaagtctaccgtaagtgccgcatcctctacccttagcccggactcgtatttctgtgtcgtgggattgtacaagcggtaggagtcgtatgtgagatcattttcccgaaagaagttgtacgcttgccattccggaaggaaagagaggaagtctccgaccagcagaggatctctcgttacgacggtaatatacagatccatggcttcgcctgcctccagagacttccgagagggtttgtcggctcgaatgatcaggcgcgaggtgttgcccggtcccttgctttcgtccgtgtcttcctcttgtggcttgaatatctgcccatagaggtaggcgtattgctcactatttttgagggcattgcccaatgcaaaccgaggcatgaaataccatttgcgttcgaaagcgatagcacgttcggctctgaaacgaacgctaaaatggtaggcggtgaagtccgataaaaagatcggcaacgaatctgtggagagtggcatacaaaactctttgctgaggaaaaacgacccaatggagaggtaacctgcgtaattctatttctaaggttctacaaattgcccgtagccgacattggtcttggccccgagaccaaaagtgcagataatagctttgaagagctttgtcctaaagtctaccgttagtttctctccatgatctttcaggataaagcgaaactgataggttacacctggttcaaccctcaaaaaacgtacaggattagggttttgcagaggattaggatggtgcgtgatatagtcctctccaaagagagtgttatctactcttataggaatggcatcgaggaaaatgtctctgtcataaatggaatattcttttcctacaaatactttctcaataatttcttcacgtgtaactccattgttgagctcataatctgcaaggaagtcccactcttcgatggcagagcgtagcatccctttgatagaagagccggggataacaggcaaacccgatgtatagtcgaagtacatcccaaggttgtaaacctctggtgcatcatcttccttatccccct

SEQ ID NO: 409 - DNA (genomic), 633 bp, PORYPHYROMONAS GINGIVALIS; double-stranded, circular
  misc_feature 1...633
  hypothetical: NO
  anti-sense: UNKNOWN
cggccgaagcttttcgatcggtatcagtcggatgtccttgcacacgtcccatcggatcgcgtacgggctccgtcccgagcagatagagtatttcagctatggtagcaccttcgctttcgatgaagctactactccatagcgtaaagctgactttcgtaggaagttcgccattgtgacggcgagcgtagtcggccagcatgtcctctgccatcttcttccctttttcccatgcagctgctgatggtgtggcctcggcattgatagagaagaggtttcttccggtaggaagcgtctccggattggcgatatagtcgccacccggcgaaggtgccgtataaccgccggagagagcgttcatcatagaggtcagctccagctgtgggctgtttttgagtgccttatagtagaaaggtatctgggcaatagcatgcttgagttcgctgatgctcgctgccatggctttgtctttggaggtaagctctcgtactggctgattcgtcatggccggttgcttggctttcgacttatcaggcatcatagcttttgccttttccgaatgtgccgcttgcatagaatccttgccgtgagaaggcgttgcgtgctctgctccatcactcttcatcttggcggcca

SEQ ID NO: 410 - DNA (genomic), 362 bp, PORYPHYROMONAS GINGIVALIS; double-stranded, circular
  misc_feature 1...362
  hypothetical: NO
  anti-sense: UNKNOWN
ggcgaagctcccgacgttcgccgcaagttcgtcgcggcaggcgtggcacatatccttgctgtgagcggttttcacgtgggtatcgtattggctgccctcggttttctcatgcgtattctgccgataccgcagcgatggcgtcgggcagagtggctgcttccgcttgcagggggatggatatacgcattcgtttgcggtttgggtgctcctgtagtccgagccatgctgatggctaccttatatatagtcggtaaatgctcgggcagaccgtacggatggattgaatgtttgggctgcggcagcgtccattacactcgtggatcgatcccctctcttttttatgacgtggggatttggtggct

SEQ ID NO: 411 - DNA (genomic), 535 bp, PORYPHYROMONAS GINGIVALIS; double-stranded, circular
  misc_feature 1...535
  hypothetical: NO
  anti-sense: UNKNOWN
ccgacaaaactcacggaaatgttcttctgcgtaaaataagaggttacggcacggtactcccgaacttcgtcataaatccggttgatcagctccattcgttctttgtcgttcatcgacagggcattgtttttgagaagcgttttcagctccttgagcgactcaccgctcatttcaagcagtttggcatagcccgatgccatagccgaaagttcttccggactgtagttcggatctttgagcatggagcgataccccgtgacgtaaatatccgtgatatcgcctaccatcaggatgatctcttttaccttgtaggcatccccgatcaggttattgacccgtcttgagcgcgtcgtaagtattttttcccctgatgatagactttctccacttccttgaagttgttcagggtgttttttaccgtcttggaagccgttgcgatctccttgaccgtgttggcgatgttgccggcaaaatttggtcggatcggtcacgacccactgggcattgtacgctgccacagcagaccggcagtacc

SEQ ID NO: 412 - DNA (genomic), 3355 bp, PORYPHYROMONAS GINGIVALIS; double-stranded, circular
  misc_feature 1...3355
  hypothetical: NO
  anti-sense: UNKNOWN
ttcatttcgagtggtataagcaaacgattgacctgacgtcagacccggccttgacatttatcttaatcttgtcttcaccgttcgcgagtcaaagtgacttcttccgttccggcaggtgaggcattgactcctcccggatgcgtattgtccggagcataagaacccgtcacatacttaaagcccaacggcagcgtgatttccaaatatgccttgggggtagtttctccacctacgaccgtttgcaccacttttactcttttgggagctttacagtccgattgtgatgttgtggtcgtaacaagctgcgtagaagcagaagtcgtgtagggctctatagctccatttattctaattggaggcgtacttatggcaagacccgatcccttggcattctgattacaagcattacggccgtcagctcttacacggaagttcttgccagatacgaacgaacactcggtctttatgtagaacttcaccaaaattttacgttgattgtcgttggattccccctctttcaggcccttgagatagcctatggtagtcaatgcaggatgctgcaacagattgacggaattattgaccacattgagtgcagcccaattaccggaaccggcaggatattccacctgtacctgattcggtgtcaccaccaatccctcttcggggaagatgctgaaagtaggactataaacgttcgcattatctgtcgattgaatgctgtaaatatattccaatgtactacacaatgtagcagcagctgtaggatctggaacagctatctcagtaagctccatggcagctggcagtggcttgagcttgagatcgatcacctgcgaactgcaaacatactcatccaaactaaggggatatgcactacagttccagccccccatcgccttcaaagcgataggagagcaaccagaataggtaaagtgaatggtatagtcaagcgcagaacctactggaacaccagcttccgacaaacgatacatcttgccaccagaataagttgtaaacgccatttcagtacctgccgcatcagttactttttcgatggtcagccccgatgttgtaggcaatgccaaccaaacatagggagccgttgcactcgatgggttgctgatacgcagcttccactctcccgttttacccacaagctctacctcacctgactgattgacgagcgcaatagaaggtttgttagtataaaggataggcctgttgtaaacattgagggcggaaacactgtagattccgttgctgccagccgattgatcggctactatgtcaaggctattaggtactgttggctgcgttgctgcataatagtaatagtcaatgtaatcgacatagtatgaaattttatcataattagttgctacagcagacgacgcacaagtgggagatacatttactttaagagctgctccataggcattttttactgtaatattgaagtgcgccttttcgttgtctgcaagttgatacttatagatgttatattcaccctgtgaagtcacatctgtatgatttatttcctcgaaaggcatggttgtacctaacgaactatggttacggtgattgctatactccaccctattcagcgtgtaggacttcggtactttcagatagatatttctaatctttacaccaggacgatattcattggcatattcaaatgcaccagagccgaaacgacgggcgtagtggttagcaacgcgtcccagatctgttggagtacattgtgaaatgacatgtggatcggtaccgtttacaacaaaagtacccatgatgtatatctcgggcacaagtatgagacaagttaacggattggcttcatcccatatcggtgacacattggcggtagagttgtagaagaaccactccctaccgacttgcgtatctactctatgagcattctgggatgttacccgataacgggtaacaacatccactttgtctctatcaagcaatccaccagcaggaaggattgaagtaaaatcccagtcgatcacctgctctgcattattatttcggcgtattgaacggaatgtcgtatatccatctaccgatacaatctgaaccccatcacggaagatcttaatatcggccgaaagaggagtaagcgtttctactcgatcgacacccgtagccaaaacaaaacgggcgcccaaagacgaagcagtaccatgctggatagaagtcgctgtaatgttgacttcgtccatatatagggctttagccaagtcgtaagccgatatattgctacgagattgacgggtccgcatcgtataatccgtccagcccaacgaattgtcggcacgttctatcttaggcaccgaagtttccgcacctctaccgcagggaggatcgcagcccaaaacataacgctttgccgtgttacacataataggacctaccgggcaaagacaatcagggaagtgaaggtagttgaatacctctctaatcttatactccacaaccatttcgtgattatttgtacagtcgtatttcacaccatggagggttacaaaacctctttcttggctgggcgaaacgatagtcattgtgtttcctgatgtcgtgatatttgcatcagggaggttaatcggtggagtgaaaactaaggacccgtctatcggatgattttttatattggtccattctatatccgatttgggaggcatagtcataccttgcgggaatactatttctaccacataccgcgtattgggattggcgtaccatatattattatatgagctgaggatggaatagtaggaagtcattatcttcaggtcgaaaggcgtatccttctctattacagtaggcatgtgagaggcatcttgtaccgactcacgagacaaatacaaatgagtactagaaagattgaaccacgtgttgggatctatccatgaggttctatcacaagatgtctgatatagtgttttaagaatcaagcccctatcggacaaatcatttggagcgttgttgcatgccgtaaactgatcacactttagccgcaccgttacagtaatcgtaatagtagctccgacaggaagatcatcataaaatccgtcaccgtcaacatcatccaaaccaacccccggtccgtcaggatcttctgtaaactgtccatcaaaacgaaggtcgagctctgagccatcggttttgaaattcgttaccggcttaccgtttactttgacatcaataaattcgtgtaaaacaaaccctcttggtctataatagtcgtttctaccaatagtattgatattgaatgctgcccccatagagccaccagcaccggaatttgagaacttaatagtcaactcaaacggttggcaaagagaaa

SEQ ID NO: 413 - DNA (genomic), 574 bp, PORYPHYROMONAS GINGIVALIS; double-stranded, circular
  misc_feature 1...574
  hypothetical: NO
  anti-sense: UNKNOWN
gggcaataactaccgttcttgcatcgtgacagcagaggctgcattgaagacttatccatacaccaagcatcgcgaagagctggtcttcctgatgcttcaggctatgtacgaagaggcctctttcagcgtcagtgaaaagttgcaaacgcgttaccgtgatgtagcggaccagtactttgcctacatcaacgaatttcccaacgggaaatacctcaagcaagccaaaaagatctacgacagcgtcagcaagcatatctcacaagacgcttgacgaatgctcatacacacccggggagtctcccatcgcagcaacataaaggagacggcagagggtggatcaacaacggaaccgatcggaagaaaaaggccctgacacaagttccgactaataacaaaaacaatcaaaaagatatatggagcttaagaaaatgaatgtccccatggacaccattacacgtgacatggtgcgtctgagcgaagacacggagaacgtgtacgaagacagtgatgatcatagccaagcgtgccaatcaaatcgggcagcaaaatgaaacaggatcttggaaagaaactt

SEQ ID NO: 414 - DNA (genomic), 945 bp, PORYPHYROMONAS GINGIVALIS; double-stranded, circular
  misc_feature 1...945
  hypothetical: NO
  anti-sense: UNKNOWN
tggcgcgagaatgaaaaaaatctcgcgccacaacgaaaaaaaagtcgcgcgtattttgcagaaaagcggttccgctttttctccttttcacgctcgtgattttcaccccctgctccggctgcacacccctctctcctgcagaatgaatatctttcaaatacccccccccgcaaaaaaacaatcaggacacagagtggggtgtatatgccactctatgtcccgattgcgttaggagggaaatgttgcttacggattcgccaccgttatcgtctgtgtgtggaagtattttgaacgagaagaaactgtgatcgtctcagccgaagcagatttattcgatttgaacatcagttccaccttgcgatcggtcgggattgccgtcaggatatagtcgtaaaaaggcttttcggcctcgttgccaaagataagcccctgaccaccggagggataaaagttgttcgtcttgattcggaaagtagtaggaagcaaagccggattgaaatcggccgggatattcatgacgatgttcagtgctttatcctgcgtcttatgtacctgacaagagactgcgttcgaagtggctgtgtattctgtgaatgcatctcctgcacccttttgtgtgcggactgcaaatggattggtaacggnagggcttcctcactaccacacgcaccagacgtttgaggtcaggattatcttgtgctcccacaatgatgtctgacgtacatgagcctgaaccgggtgttgcagccaatgacaacgaaatcgtaccgttgttgttagtagcaccggttactgcatcaccgctatatgtgacggtgatcagattgttctgctgtgttacgttgccaacattcggataataagccgctttgattgtgcccgttgtctgcccatcggtaaaggccaagtaagtatgatccacttcgatcttacctttccggggat

SEQ ID NO: 415 - DNA (genomic), 2844 bp, PORYPHYROMONAS GINGIVALIS; double-stranded, circular
  misc_feature 1...2844
  hypothetical: NO
  anti-sense: UNKNOWN
tgaacttacagttcttaccgggcactgtcctgcaacatggcaacattaccacctgccaaagaaaaatccttcaaagccgtttgccactgcccgagggtatgctgtacggccaagcgaatatccgtatgttcctcggctgagagaaagctgtaatctccctgtccgatcgtacaggcatagccgctgggaaacttttgtgggatagaattcggtctatataggaattgtttccgaccaaaggccggcgcatagccaccgctgcgagagtagaaatcgtacagccatgtttcggcaggaataaggaaactacagatatcgccacggtcatatatggctgaaagagcttccgccatcatcgtgcgcataatgcctttgccacgatgatcggggtgtgtgcatgctccggaaatataaccggctgagaaagaagtgccaaaaattcgcagttgataaggaagcatttgcagatgtgctacagcctctcctgtctcgctatactgtagcaaggtataatcctcacggaaaactttgtggaaataaagctcaatgaaaggctcagggtctttgaagcagatgcgccatagccgcacagatgcttcacgcttggattcggtcatgatcgcgtcgcagtatggctgtttgtttgggcaaaagaatggcagggcgataagatagtttggcctggcgcagtcccggcagccccaaatcctcctcgcgattgatgtagcggaatgtgtccggtatcgaacgggcaaattctctattaatcatcgcaaacgcgccttccaccatagcatcggccttttcgatatgtaccccaaaagtgtcggtattgataggggagcctaaacagaaagccactacccggccaccgactcgtagtactccccccgaaagccccagctcctgacgatgccgaaaagcacgctctaccatctctacctccagctctcttccgtcctgatcacctcggctatccagccatagatgagccagcatcaagcattcttcggcatcgctatccttaacaggatcgtatgtatagtcaggatagagagagacaaatttattgatatgattgcgcttggcctgcaactttttgcctgacaaagtcgctaaactttcacgttcgtatatgtagtcgcaataggcttcatcctcgataaagtaatactcagccgagcaatgttcctctatacatcggtgaatatcgggagtcacacccataaatatcaagggataatcttcgtgcactacttctgctttcagtcgatgggcagcggccactacttgctcaggatcagctcccacaggaaagagatagaccggatgactacggcttttcggtttgaaacggatgatcagacagccctccacaatagcccaagacgtgccatagacgaaactccagcaatagagattggaaaaagccaggtcgcaaattcttgccactgaagaaaaggtgatagttgttatagctgatctgtcagcaggttctaccggtttgaatttaatattcattcgcattggttttgtcaccccctgttcatatagaagggagacgttaatttatcggtgaaacacctttaacaccgaaaaagtttcatccttttccctatttcaattcggcaaatgtgtcacctgcggagaaatctcctgtctcgaaccctcgtttgaaccaatacatcctctgagaggaagtgccatgtgcgaaagcatcaggtaccacatagccctgcgattgtttccgaacaggaagatgggctataccacagggcagatggtggtactccgtagaggataacgggctatcccgtacggctcttcgagctacgctgtagagctcagcgaggtacgctctacagcgtagcgagccgagccgtagagttccgctccgggagccgtagaggtggccgagctgagccgtagagcttggcgcggtgagccctacagcgtagctcgaagagccgtagagcgcagctcggtacgctctacggcgtagcccgagtcgctgtagggcgtagctcgacccccttccggagtatattccgaacggctataaaacaatgcttatttggttggagtaaaagagtcgcccgactcctttttatggaagccgggcgaccgattaaagcgatcggttggtagagcataccgatcgaaaataatcatctcgttactttacagcgagtttctctacgtaggacttgccgtcaacgacaaccatgactgcatagtggccgccctgagccgtgtaaacaaccgtgttgcgacccgctgccagacgacgaccgttcatgtcgtagatcatagcttcgccttggcaagttaccgtgatcgtctttcctacaactgtcagcgtgtaaggcttctgagccgttacgtctgccaacgaagtgatattcaacgtagcagtttcgatagctgattctccgttcgggtaaacaacctttacaccgtacgtgtaaaaaccggtagccaagtccggatctcggtaagtagtctccgttacgcctgatgctatctgtgtattattacgatagatcgtataggtgtaagacggagcgttccctgaagtgattacaacatcatcaaggttgatccagaagaagtccgtacagccgaagtgacggaaggcaacatacttagtacccgcaggcaactgtaccgtcttttgataccaggtgccctgagcacgagtaccacgaatggcttcaggtgccgtaacaactgtcttggccgtcagcacttcttccaacaaagcgttggcgaagttggaagcgtcgttacccgtagaagatgcgtacacggcatagtgctctgatgcataattggcatcttgtg

SEQ ID NO: 416 - DNA (genomic), 513 bp, PORYPHYROMONAS GINGIVALIS; double-stranded, circular
  misc_feature 1...513
  hypothetical: NO
  anti-sense: UNKNOWN
gccggccgttgagaaaaggactgtcgcggctcttcgtttcgccccgatcggcctgcttctcgttgctgcgggagctttctccatacagctgacacgagagcgactgacagctacttcacgctacaagctgtcttcatccgacacttttcgggtcatcgggaatccggagccacgcgagggcaaactgcgaatgcaggtacaactgacaggaggctcctccccatcttatatcctgtacatccgacacgaaggggaatacgagccggtcgctcgcggcgatatgctcaagcttaggaaattctatgcccgatcggtcgaagaatgggagcagaaagctccggcaatggggcggtatatggcgggcaaaggactgtccggcagtctgcatgccaagaccggagatgtagaaatcttgtcgacagccaaagggccgttctccctcaggcaaaaaggctttggatctgtcggatcgcttggctgccacattgtacgaactctccccttcgctactgg

SEQ ID NO: 417 - DNA (genomic), 357 bp, PORYPHYROMONAS GINGIVALIS; double-stranded, circular
  misc_feature 1...357
  hypothetical: NO
  anti-sense: UNKNOWN
ggatggagtggagcgtaagctgacggccgaggatctgatgatatgcgattcgaacggcgatcccatgtgtgtggcgggcgttttcggtggtcttcactccggtgtaacggaaaagacaacagatatattcctcgagagtgccaatttcaacccgacgatggtacgccgtacggctcgccgattgggtctcaatacggacagttctttccgctttgagcgcggattggatccggagcgcacggattgggcattgcgtcgtgctgcttcgcttatattagagattgcaggaggccatctcggtgggatgacagatgtttattccaatcctctgaaaccgcacctaatcagtttgtcttt

SEQ ID NO: 418 - DNA (genomic), 1084 bp, PORYPHYROMONAS GINGIVALIS; double-stranded, circular
  misc_feature 1...1084
  hypothetical: NO
  anti-sense: UNKNOWN
ccttggacggtcccctcaatatttgtctcagaaatggattccttctcgttttttctctgtcagtgctaagacaaagatagacatacgaaaccataatgccgataatatctatgctaatacattcaatgataatcatatccatgcattagaaaagccgaaaaatcacttttccggtatcaaacaggatattgagatgaaatggcttttgagcaaagggcttcttttcggtggaggaagttttgttttcaacaaaggaaagatcaatagtgatatatataccgatgtcttactgcttccattaccccatataaatggaaattctatttatccttattttcatgaacacataaaaaaagacatggaaaaaggattcaacgcctacgtaggtggaatgtatcctgtattgaataatatatatctgcgaggtgagttttccatgtcgatgaatggaatgaacttaagatggcttatcctacgagtataaacgaggaaacagccgatttaagagtattcaggccttacattagtctgatgaaaaacaagggggtattccggtttaacataggctcttatttttcctcctatagacaaaaaacatctccggaactattgagagagaaatctcttttttatattgagccacatgcttcaatcgaattagtaatgagtaaccagcatcggttaatgctgtctgtctctgaagctgtttctccttcaaccatcgattacttttctcagcagattttggctaaaggatacaataacctccaattaccctcaaaattatcgaacccttttgcaaaaaggtttaagggaaacttatcctatgcctatttcagcttgtttaaccggctttcgatgtatggcaatttaagttatatcaaggatagagatacgcatattaccgtcacaacctcaaagggactattgatcagtaatttttatcaagatggaggatggagcaatacattaagaacaaacgcctatttgagtaagggaatcggcaccctttcattggacataaaatatcaggtaaatatacgctcagcaaacacaacctgatgcgtgtagataaagaagacga

SEQ ID NO: 419 - DNA (genomic), 629 bp, PORYPHYROMONAS GINGIVALIS; double-stranded, circular
  misc_feature 1...629
  hypothetical: NO
  anti-sense: UNKNOWN
aacaagctgacatcgcttcccagtcgaggattgaccggtgcaccgtacttaagcaccagggctccgccagactgaatcaaagaggtgaaatgttcgaagctgtcgcgataattctctgccgtgccgtatatatccatatgatcgggatcggcagatgtgataatagccataaaaggtttcagatggtggaatgaacgatcgaattcgtctgcttcgacgactactaaatcacttttgtccgatagcaacagattcgattgataattgttggaaattcctcccagaaacgcattgcagtccacatggctctgtttgagcaaatgtgccagcaaagtagaggtcgtagtcttgccatgtgttccggcgacacagagtgcacgttccatcagagttatctcgccgagaacttctgctcgcttcaccacgcgataaccattggatctgaagtaggtcaattccgagtggtcggccggcacagcaggggtgtaaacgatcaacgaatcggtgggagaaaaaaaagctttcgggatcatattcaggtcatcactgaaatgaacctcaattccctctttgatcaattgatcggtaatgggactcggagtcagatcatacccacacacattaaatcc

SEQ ID NO: 420 - DNA (genomic), 839 bp, PORYPHYROMONAS GINGIVALIS; double-stranded, circular
  misc_feature 1...839
  hypothetical: NO
  anti-sense: UNKNOWN
cgtgccggtctgctgactacagaccatggccccatagagactcccatcttcatgccggtaggcacggtcgggagcgtgaaggccgtacacatgcacgagttggaagaggatattcgggctcagattatactcggcaatacttatcacctctatctccgtcccggattggatgtgctcaagcgtgccggaggcttgcacaagttcaatagctgggagcggcctttgctcacggatagcggaggttttcaggtgttctctttggcggagaatcggaagatcacagaggagggtgcgactttccgttcccatatagacggctccaagcaccttttttcacccgaaagggtcatggacatccagcgcgttatcggagcggacatcatcatggctttcgatgaatgttgccccggtgatgccgaccgcgaatatgcacgccgttcgatgctcctgaccggaaggtggttggagcgttgcctgtgtagaatgcgcgagacggagccactctatggatatgaacagcagctattccccatcgtgcagggatgcatctatcccgatctgcgccgccggtcggccgagatggtagctgccgtcgatgctgccggaaatgccatcggaggattggccgtgggagaaccgacggaaaagatgtacgagatgatcgaactgaccaacgagatccttcccaaagatcgtccgcgctacctcatgggggtaggtactccgatcaatatattggaagcgatagaccgtggtgtggacatgttcgactgcatcatgcctacgcgcaacggccgtaatgggcagctctttacctgcacggaccatcaatatccgat

SEQ ID NO: 421 - DNA (genomic), 2835 bp, PORYPHYROMONAS GINGIVALIS; double-stranded, circular
  misc_feature 1...2835
  hypothetical: NO
  anti-sense: UNKNOWN
aaaggttcgcccgtgaagaactccgccctcacatccaccggtctggttcctttcatggaacgctactccaacagtacgcgcgaagtagctcaagacggccgtcgcggtgcacttatgctgtccgtatccatcaagcatcccgattccgaatccttcatcgatgccaaaatgaccgaaggcaaggtgacgggagccaacgtatcggtgaagatcgacgatgaattcatgcgtgccgttgtcgaaggcaaaccctataaacaacagtaccccatcgatgccaaagaaccgaagtgggagaaagagatcgatgcgcgtaccctctggggcaaaatcatccacaacgcttggaagtcggccgaacccggtgtactcttctgggatacgatcatccgcgaatcggtacccgattgctatgccgatctgggcttccgtacagtctccaccaacccctgtggtgagatccctctctgcccctacgatagctgccgactgctcgctatcaacctctattcctacgtaaagaacccattcacgagcgaagcctccttcgacttcgagcttttccgtaaccacgtcgttttggcacagcgcatcatggacgacatcatcgacctcgaagccgaaaagatcgaacagatcctaagcaagatagccagcgatcccgaaagcgaagaagtcaagacctcggagcgtaacctctggcacaagatccgtcgcaagacccttgccggtcgtcgtacaggcgtaggtatcaccgccgaaggcgatatgcttgcagcgatgggattccgctacggttcggacgaagctacccaattcgccgaagaggtacagaagaccctcgcactctgcgcctatagcagctctgtgaccatggccaaggagcgcggcgccttcgaactgttcgatgccaaacgcgaagagaacaatccctttatagcccgtatacgcgaagccgacccatggctgtacgaagagatgaagcagtacggacgacgcaatatcgcctgccttaccatagctcctaccggttccaccagtctgatgacgcagacttcctccggtatcgagccggtattcatgccggtctacaagcgtcgcagaaaggtgaatccgagcgacaagaacgtacagatcgactatgtggacgaagtgggcgacagcttcgaagagttcgttgtctaccaccacaacttcgtcacttggatgcgcaccaacggttacgaccccgaccgcaaatacacgaacgaagagatcgacgacctcgtggcccgttcgccctactacaaggccacggccaacgatgtggactgggtagccaaagtgaagatgcagggacgcatccagcagtgggtagaccactccatcagcgtaaccatcaacctcccctccgatgtcaccgaagagctggtcaataccctgtatgtggaagcatggaagagcggctgcaaaggctgtactgtctatcgcgacggttcgcgcagtggcgtccttatcactgacaagccgaagaagaaagacaagaaagaggagccggcagctctccaaaccacagtacagagcatgcttatctcccgtccgcgcgagctggaggcagaggtcgttcgcttccaaaacaatcgtgaaaagtggatcgctttcgtaggcctcaaggatggacgtccttacgaaatcttcaccggtatagccgatgacgacgaaggtatcatggtaccgaagagcgttacccacggcaagataatcaagaacagggacgaaaacggcgaacgacactacgacttccagttctgcaacaagaaaggtttcaaggtaaccatcgaaggcttggatagcaagttcaatcccgaatactggaactatgccaagctcatctcgggcgtcttgcgctacggtatgcctatcgagcaggtggtacatctcgtacagggcatgtcgctgaacgatgaatccatcaatacatggaagaacggcgtggagcgcgccctgaaacgttacctccccaatggcaccaccctgtcgggacaggtatgtccgagttgcggtcaggagacattggtttatcaaggaaggctgcctgctatgcaccagttgcggagcttccaaatgcggataaagcacaaaaccggcagggtatcggttctataacataatacctctgctgccactctacatttcctttactgttcaagagggcatgtccgggctatgattcggcatgccctcttctttgtacccttttttccatattattttgcatgccacacacttaattttctatagatttgcaactaatccacaaacattacaagtatgattacaacattaggcgagtatgcattaaaagcagctattaaaatcggcttgaatatccacagttttcatcgttctgaagtcgatgagcagatccgatccgctttcgaatatgccgtaaatgattggtcgaaacacgatgtgggaataaccacacgaatcaacctaaaacaagcattagaggcctatgcccaaaatccgacttcattcaagccggaggatcaagaaatacgagattttattgcctgttttgagaaacgacttgctgaatccaaacaccaagcagcctacaactacttgacccaattggagaatagagaggaacatacccaaatcatggcaaccatcaaagaaaaaggccttgatccacgggatattgaacgatacttgaaacaactgccaatcaaagaaggtcaagcaaaagcggaacaggccatcgaagatttataccaaagtcgtgaaatagaactccctttgcgcgagatattgcaaatcatagtccgaaatctgttcgaacactcggcc

SEQ ID NO: 422 - DNA (genomic), 475 bp, PORYPHYROMONAS GINGIVALIS; double-stranded, circular
  misc_feature 1...475
  hypothetical: NO
  anti-sense: UNKNOWN
gcaggatgcaaaaaggaacgtcagtgcggcgaaaaaaatgagctttctgcttgtcatctgtttttgtcttatgatggacttaacctcgcaaagatagccgttttctatatataatgtagttgccgtgtacagattccagttataaatgcaacactaagtcagatctagtaagaagcgttcgaaggggtgggctatattcagggctgaggcattcaaaacagcgttctatatggggctgtgtcaaaatccgaaaatggattttccaacaaaaagacacaaatgccaccttaatcatatcgggaaaaccgctatcaagtaggatgattttgtccttttggtagcggtttctctatacaaattatacaaatgatagtatcctttactctaaacggaattttgacacactctcatctatcttctgtgatcagaagataggcaaggaatcggctcgatcggtcggtaatggtgaggggaa

SEQ ID NO: 423 - DNA (genomic), 566 bp, PORYPHYROMONAS GINGIVALIS; double-stranded, circular
  misc_feature 1...566
  hypothetical: NO
  anti-sense: UNKNOWN
ggcagtggcactttctccatatttgtcgaacgcgccctgcgggagacctttcattacaagaaatcgcttcgttacatccatcgctctctccttcccggtaaggaatggaaagacatgattcgtaaggaactggcagaaaacagacctgtgtattatgccggtgcagacggatcgatgggacatgctttcgtttgcgatggatacgaaccagacggaacgttccacttcaactggggatggggtggcatgagtaacggtaatttctatctcaatctactcaatccgggttcgcttggcacaggcgcaggcgatggaggctactctactgaccaagaggttgtcataggcatagagccggccagcaatgaagtccccggtatcgtaccggatccgaccatcacgctctatggattgcaacacaatatgtctgatgaagcacttgacctgagtgtaaaaatcaagaactactccacatatgcaggggatgtgaaattggcttatcgcctgacgcttcccaatggaacggaaacgactaacccagccgtcaccgtccctatcgttgggaa

SEQ ID NO: 424 - DNA (genomic), 861 bp, PORYPHYROMONAS GINGIVALIS; double-stranded, circular
  misc_feature 1...861
  hypothetical: NO
  anti-sense: UNKNOWN
gccatgcttcgtgccacgacacaggaggagcttttcgctcttatggacgaggtggagaagatgataggatcggctgattcagcggcggtatagtcgcttggacaaagctccccctgccgattgcttcaatccacaggtctccgcatgcaaatccgtcaactcggcatcatgtttgccggtgaacatctcgttgtggcattcgcatagcaaccagagcagatgatcgaaggcggtcagctgttcgtccgacagggcggaaacgagtgtctcggcacaaaggcgcaggttgggaaagagattgaccagtacctttcttccctcaggggtaatggagacacgcatacttctgcgatcctcctcatccggtctctgctcgatcagattagctttcagcagacgacgcatgacttctgcgccggatgttttttccatggcattgaggttgttcagctctgtcttggtcatgctctcaccgttcatcaggctgaccagataggtatattcgtcttcggtctgtaatggagattccgtcagagctttcttgatataaaaacgggaataacgatggaggaggctgacccctcgcgctatgttcttagctcctgctgctcgttcccgggtgacagagacaacttcttcctcctgtttcttctttttgccacagcgccaacttaaaaagtcggcaaagtcttttatttcgggttcgtgcgagcctccgtcgtgcaaactttcaaatgcatcgaggtagtcaataagatcgaaaagcagttttttgtacttcataaattactccgattgaataaatcgtccgttcgatgtaatccttttgaagcataaatgtacatttttccactgaaaagc

SEQ ID NO: 425 - DNA (genomic), 3106 bp, PORYPHYROMONAS GINGIVALIS; double-stranded, circular
  misc_feature 1...3106
  hypothetical: NO
  anti-sense: UNKNOWN
gcatncaaggnatatgacggcccaatggtgatccgttacccgcgtggcaaagggtgcttgaccgactggcgcaacactccgcgactggtcgaaatagcgcgaggacgctgtctgacggagggcgaagctatagccttcctctccataggccccataggcaatatggtacagaaagtggtggaacggctggctgagaaaggtgtatctgcagcccactacgatatggtattcctcaaaccgcttgacgagganatgctccatggcatcgcaaagaagtttgatacgatcatctccgtcgaagatggttgcatccaaggcggtttcggatcggccgtcatggagtttatggcagaccatgactaccacccacgcatccgacgggtgggagtccccgatcgctttatcgggcagggatctgtgcccgaacagtatgcagactgtggcatggatgcagactctttgttgcacttgaccgaagaacttctgctgcatccgtaggaaaaaggaacgaaggatgctgcacggatcttacaaaccttaatgtagcaagatgaatattgttatagccggtgccggcgaggtgggcacacacttggcgaaaatgctttcgcaagaggaacagaacatcgtcctgatcgaccccaatcccaaacgattggaactggccgccatgcgttccgagctgctccctcaggtgggcaatccgctttctccttcagacttgctgcaggccaatgtgaagtatgccgatcttttcatcagcgtgatgccggaggaggcggacaacattttggcctgtgcccttgcctcacgtttgggagcaggaaaaacgctggcacgcatcaacaacaacgaattcctcaaacccgacatggcacagtacttccgcgatatgggagtccataccatgatttaccccgagctgctggctgcacgggagatagtatcgaccatcaaaaacccgtgggcacgtcaatacgtggagttgttcgatggggctttggttctggtgggtgtgaaggtgcgtgagggtgcgcacattgtaggcaaataccttcatgagctgacccggacgggaaataagatattccacatcgtcgctatcaagcgtgaccttgagacgatcatcccgaaggggggtacacaggtactgcatggagacatcgtattcttcgccacggctcaaaaccacttggatgaagttcgcaagctcgcaggcaaagacaatccgnccgtccacaaagtggtgatcatgggaggtagtcgcatagctatccgttccatagagatgatcccgagaaacatacaagtggcgatcatcgagaaggacaaggagaaaagcatgcggatcagtgccatcgctccgaccaacgtacaggtgtacaacggtgacggacgcgactcggacatcctcatagaagccgggttggatcagaccgatgtattcatcgctctgacggaaaattcggagacgaatgtcctcgcctgcttgggagccaagcgtttcggtgtattcaagaccatcgccaaggaagagaatatagactacatttcattggctgaccgccttgatataggcacgctcatcaacaaaaaacttttggccgccggctccatctaccgcatattcctcggcgaagatacgagtacggtgaagtgcctgacgctggccaatgccgatgtggccgaactcgtggctcatcgcggagcacccgtcaccaaaagaccggtgaaagatctgaacattccggaggggattaccttcggcggcatggtgcgcaacggtgtcccgcaaatgatccatggcgatacggtgatcgaaccctacgaccatgtagtggtattctgtctgaatacaccactgaatatcctgaaagacttcttcggctaacctctcttttcggacggcacggcgatatgttgcagcacatcaatttcaaattcgttctcaaggtggtaggctctctatgcctgtccgagattctctttctgttgatttgtctgggtatatccgtctactacaaggggagcgatctgttgccctttgtttacactataggagtgatggccgcggtaggctcctgtttctacctgctgggacgccgtgctcgtatgaacaacgcaagtcggcgcgaagggatgcttactgtcacgctgacgtggctgatcctatcgcttgtcggcatgcttccttttgtcttcggcggatatactccctccgtgacggatgctttcttcgagaccatgtccggcttcacgaccacaggagccacgatattccccgaggtggagtctttgccccgaggcattcttttctggcgtagcattatgcagtggcaggcggtatcggtatcgtggtctttacggtagggctgctccctatgctcggtgcaggaagtgccgtttcgcaaatatacaatgcggaaactacgggcatcatccacgatcgttttctgccgcgtatccgtcaggtgccacgccggctctgcggtgtctatattctcggaactgctgtgctgatactgcttttgtggttgggcccgatggggctgttcgatgccatttgccacgctttcacttgtatttccacgggaggctactccacgcgcaacggcagtatcgcggagtttcagtcctcatacatcgaatatgtcacctcgtttttcatgttctacggcagtctcagcatcacgcttcagtactttctgctggtaggaaaaccgggaaaactgattcgtgatgaggaaatgcgcacctttgtcgtcctgaccctctgtgccgttttgatcactacgctatggcttttgtatcggggggaatatccgagcttggaggaaaatttccgtcatgctctctttcaaacctattcgatcatcagtaccaccggctataccacggccgattacttctcgtgggggcctttcttctggagtatagctatcgtgatgatgattgtctgcggctgtgccggatcgacgacgggaggaatcaaaatcagtcgcctcgtcgtcctgatgaaaaacttgcgtaacgaatttaagaagcgtacccaccccaatttgatggtacctgtacgaatcaatgggattatcatcacaggacaatt

SEQ ID NO: 426 - DNA (genomic), 856 bp, PORYPHYROMONAS GINGIVALIS; double-stranded, circular
  misc_feature 1...856
  hypothetical: NO
  anti-sense: UNKNOWN
tacatacggcgctgaccatcgatcgtaggctcgaaattttcgaggacgaatgtgcgaaaagcctccacgtcaccatcctctgcacgccataaagccgctgcttgtgaagtgccacggtcggctcggaaatgaacctccttgccatagcgttgcaccaatagatctgtcagttcactgagcatttcctgccgaaaggaggacatacgtttttgcatcgggtttatattttgaggtttcaccgtttgagctgtcgtgtttacttgggcaaatgccgtgtatcctcccaccggaagcaaagcaagcgaccatgccaacgccagcgatagctgttttctcttcttcatattattactattgaatttagaatgaatctctccaaatgtaacgacaatcgaggaggtaggatataaattttgaataaaaagcagctatagagtcacgcagtagcgtttgtggaaataaaaagagacgtacctccggaggggagatacgtctctgctttttcgtttttgtatctgctctgtatgagcaggggagtgaaatcagggattagcaaacgccctgagctaccatagccttggcaaccttcatgaagccggcgatattggcacccttcacatagtcgatgtagttgccgtctttaccgtatgtaacgcactgctcgtggatgtcttgcatgatctggtgcagccacttgtccacttcttcattcgtccaaacgaggtgcatagcgttctgcgtcatttcgagacctgagcaagaaacaccacctgcattaacagccttacccggagcgaagagcatcttgtttgctacatagtattcgctggctttcggccgacaacccatgttagaa

SEQ ID NO: 427 - DNA (genomic), 998 bp, PORYPHYROMONAS GINGIVALIS; double-stranded, circular
  misc_feature 1...998
  hypothetical: NO
  anti-sense: UNKNOWN
taaaagattaggtacttttcaagaaaaccatcaagtactttcacaaaaagattaggtactttttattggattatcaggtacttttgaaaatagatttattatatttgtagatgtatttaagaaaacgcctttcagaggatttctccgaccttgggaaggtttatcaagtggagactaaaacgtatgtaataatggcaagtaaaccattgcaatttgtggtcgtagagcgaaaactgaatgtgggtaaaaacgcaggtaaagtaatgcagatagcaagaccgacggggagacatcgtgtagactttcgctccttttgcgaacgtgtatccaagtccaccacattcaaccgtcaagaagtcgaggctgtattgaactatgctacagagattgccaaagacattgtatcgaacggcgacatcgtggagtttggagaccttggcacactaatgccttctttcaaaagtaaggcggtagaacagggggtaaagttcaatgctaatgttcacatcgaaaagcctgttgtcttgttccaaccttccaaaaagtactttactctcaccgatgtaagctatgaacagacaactgccaggccaaagaaaggaacaaaacctgctccaaagcctgataccggaagtggggggaatagcggtgagggcatataagaattagataagcccacacttaacctttcagaagtttgtaaaaccagaatagagagtttgctttgccttggagcaaactctttctttatagacttttctgaatcttgattagccccttttgttcatcatctttgaggtggcttttgatggtgtcggtctcaacgtcttttagtgcatcggcaaaaacgagtttgagggaaagagccatctcgtcttgtttgccgacacagaaatgcttccaaatattccaaccgaaatgatacaggtctaaagagatatgaaagcctctttgtctatcactatacaaactccgtttgaatcatcagcatagtaagc

SEQ ID NO: 428 - DNA (genomic), 2402 bp, PORYPHYROMONAS GINGIVALIS; double-stranded, circular
  misc_feature 1...2402
  hypothetical: NO
  anti-sense: UNKNOWN
ttaaggcatagggggtaagtgtcgccaagatgattganttccccaatcgattttggcttgttgttcccatgacatagtcccacgtaaagactttcctcctctttgtgctgatcgaagaggttataaggtgttcccgatagatgtaatgcctttgtatccttacccatcaactgacctaatacggctttccccagctcggtctgtgtcccttcgtgtgcctcgtccacaatcactaaatcccatgaagtagagaagacttcgttgtttttgtcaaacttacctcctacgtccttcgaaccacgcatatcttgcatagaggcaaaatagacacactttttcccttgggaagcaagcttttcgagagaagcgaagctctcacctttgctacgggagccatagtgccactcaggacggtcgtagaaggttttaccaaagtcctcaaaccagctggcatctaccaccgggcgatgcgtgatgataatcgtacgcacagcttccatctctttggcaacacgcagggcacagagcgttttgccaaaacgcatcttggcattccacagcatcttatttcctttgcggaactgcttgagcgtgcgctcgatggcttctttctgctcaggacgcagaataatggggttgtcagatagcgtcacttcgcttgcccccaagctatccttgccctccttgatggctgagatggcacgcttgacggttgctaagtcgcaagaataccactcggtagctcctgcaaaagacttgcgtttgacgcctgaacgctccagtacgctatgcacttgcttgtcgttgaatgagcagacacgtccacctgagaaataaatggttagctcggtatatagcaattcgtaaccgatacctgcagttttggtatactggtcgatacgagctttggctgctttgttgagcacctcactattcggttcggtggaagccgaacccacatcatcgttaagggtggtttctcctattttgaggctaccctcgtgccgggcatctgcaatagcaaacacatagataaggcggggtttgagagaagattcaaaggtcgccatagtgagagattatatattattctttatcagatcaacgaatcgaattttgcgattattctctcccgtcttggggtctttacagccccagtctcgaatgaggcagtacgtgccgttatgctttttgatgctttcgttttggcagccggggcagagtatcagctcctccatagactcaaagaggtcgtccgggaggacggacacaccatgtgtgcaactattagggacgactcccttgagcccatccatctgccagacattccaagagataatataggcaatatactcaatggatttgtcgaggggacgcttaccgaacttctcctcataatactcgataaaggtgattagtagtgcctcacgagcaaggagcaggttatcgccttgccattcataagcatagatgtttttatatgccttttgagccatcttgagccattcgccggtgcttgaagtattctctgagatgatgcgaagctttctgtcgagcataccgatacgttgaggaatagggataaactcccccgtagtagtgtcatacctgctcacaagataaggagcttcgccacaagtaatttccatacgcgtggagcatacatagtctttccatgtcttaccttcggggaatgtaataggttcggtagttgcaatccaagtctttgtctcgggttgctcaatattaaacacatccttacgaccaaaccaagcctcatcgatcagattattctgagcgttgcaaacccaagagggggtgaatacttctgctttatccttggtgcggttggcttgttcttccttggacttcagcactctgggctgtattacagtgtcatgctcccctgtaatgctgtcagtcgtaattggtgcatcgtatttggtacgcatctcccagtgtagtatagtcatctgtagcccaaaagatattcctctgagtcgtatggtcaaagaggagtctttgcagaagtccttcggactgacgcagtagttcattctcactaatgtcgacccccatcttcatatcgctcacgagtaacctctttgcatttgacaagcagtggttgtcaaattactgtataccatatagaattgccattttgggcacagattagaaataggcacgacaaatctgcccctactcttagccaccggttggggacatcaccaggaaaaagggcctcggtcttttatcgttttatctaaactcattacataagcaaaggtactaagttaggggcatactaacgaagggaaatggatatttctttaccgagtagatcaaagtgcaacagatgggataaacagcagagatttccgggcattcgggttgggcttttt

SEQ ID NO: 429 - DNA (genomic), 474 bp, PORYPHYROMONAS GINGIVALIS; double-stranded, circular
  misc_feature 1...474
  hypothetical: NO
  anti-sense: UNKNOWN
tattctttgctcctgagagagggctggtttctatcctaagtcgctacaacttcactatcgaggagaactcacccgaggagcaacaagtggcactagacccagagctactcggcaaggtctttgagaatctcctcggagcatacaaccccgagactcaggagactgctcgcaaccagagtggctcgttctatactcctcgagaggttgtcaactatatggtggatgagagcctgatttcttatttaggagatagcgatctggtgcgctctctgtttagaccagatttcgtactgcaggaggacaacaaagtgcaatgcgaagctattgcaagcaaactcaaagcagtcaagatactagaccctgcttgtggctcgggagcattcccaatgggattgctcaataggatgattgagctacttgagcgcatatctccccaagagaaaagctatgatctcaagctctttgtgatcgaga

SEQ ID NO: 430 - DNA (genomic), 524 bp, PORYPHYROMONAS GINGIVALIS; double-stranded, circular
  misc_feature 1...524
  hypothetical: NO
  anti-sense: UNKNOWN
gttacgtagacttgggattaaaatgtgcctgcccctgcagatggatcgaatcgaatatctggcacgaggccctcatgagaattatgtggatcgtaggcagagtgctttcttcggactgtattccgaccgtgtgagccgtatggtcgaaccctatgtacgcccccagagtacgggcaatagaaccggccttagagctctgaccctgacggatgattccggcaggggtatcagggtggaagcttcgggacaggtcgatttctccattcttccctatgaggacgaacatcttgcgcggactcgtcatcaatgggaattacccatgcctgcgcatcatatcttgcgcttcgactatatgcagcgcggactgggcaatggaagttgcgggcccggtactgctccgacatacctttgcccctcatcgggcacttattccttcgaacttcgttttcgtcctctctgaatgtgtccgcagctacttcgaatgcgaagagaacgggacattaattctctttcggtgaagcccg

SEQ ID NO: 431 - DNA (genomic), 1284 bp, PORYPHYROMONAS GINGIVALIS; double-stranded, circular
  misc_feature 1...1284
  hypothetical: NO
  anti-sense: UNKNOWN
agacaggatgcattcatgcctgagatctcttgagcagtcggattcgtgatcgctgcccacgagagcaaaatcgttagaaatgctctaaaaacaatacttttcatcatgatagccattatttgattcgtaatttttccgtatctataattttctgatcaacatttagcgttaccaggtagaaaccgggatcaaagttggatgtattgaactgtatgctgtaataaccttcggatagatgtttgggcaacccggttatatcagccgaggctccatttattccatatatttttattacagaacaggaagggttatcggtatagtagattattgttacaacagctttcgccggattgggcgaaatagagattatcttggatttatcaaggcttgatttgttgcattctaatggaggcaggagagtacctgttgattcgggaagagttgacaacaaataattttttacattttgatggctttcgagcgatttcctttgttcacaggaaagtatgttcaaatctataccagtccctctgagtgagtctaactgcatattccaataaatgtcaccaaggtcaatgactgcaaaaacactgtcctgataggagatttcactattcaagcgattttcgtaccaatcgatggcagactgatagttttcacacacaatatcgcatcgcgcagacaggaaatcagctgtcgggaacaagttctgggaagagatgatggttggattggatctgaaataatctttcaagccttcgtaatcgttgcctgacattttctctatcctgaacaattccttcaaagcagctattgcaaagtcggattccgggtaggtttcaaccatcatcttgagagccacttttgccgaaagataatcgctattgccaatacagtccaatgctgtttggaattctactgcttcagcagagctattgcccgatctcccatttggcaatccatcccaaaaaggtatccaaatgaacaagtctggcgtattgaaaacctgattcggatcaaacaaatcattgttgccccagtgattatttgaaacgtcaatatagcgattcgtatacgtgtcgttgtaaatccatgtatctgtatctcccccctgcaagctgttgtaatggaagttgagagggaatgtaccgtttgatgaatagagctgccaagtcctattagaaataaacgtctgcttatcttcttcattgattacaggagcattatcgaaataaaaacaactgtgttgaggagacgtactcctatatgatgtactgatctatt

SEQ ID NO: 432 - DNA (genomic), 657 bp, PORYPHYROMONAS GINGIVALIS; double-stranded, circular
  misc_feature 1...657
  hypothetical: NO
  anti-sense: UNKNOWN
ggacttacgagaagtttctgtccgagggtcggcatggggaaatggactatctggagcgcaacagggagcttcgctattcgccggcagagctgttgccgggtactcgtacggntatctccgtggcactgaactattaccccaagatcaaacaaccggcctcggctccacaaatagcttactatgcttatggaaaagactaccacaaggtcgtcaaacgcctcttggacaagctactggattatattcgtcgggaggtctgcccctccgtctcgggacggtctttcagcgactctgctcctattgccgaacgctattgggcttgccgtgcaggtatcggctgggtagggcgaagcggcatgctcattttgccccgagggggaactttctttttcttgggagagctattggtggatatcgatctgcctcccgatgctccgatgccatcgcgctgtggagcttgccggaactgtatcgagagttgtcccacgggagctatttccgaagaaggcatggactctcgtctctgtgtgagctatctgacgatagagcatgagggggagatccctccggaactggtcggtaaagctgggcaaccgtttctacggatgcgacaagttgccagcttctgctgnccttggaaccgatatgcccatncat

SEQ ID NO: 433 - DNA (genomic), 506 bp, PORYPHYROMONAS GINGIVALIS; double-stranded, circular
  misc_feature 1...506
  hypothetical: NO
  anti-sense: UNKNOWN
aaaagagactaaaaattttcaaacgcaatcgccctgaccatctgtccgatatgggatccatggtattatatcgtcttcctcctcattggtattgttggctgctactgtgtaccgacgcggtagccggatggattattggagccggaggaggtatcggctcgtatggacgcaatgtgaatcagacgccacagcgtggcacacaaagtgcatacacgggtagcgaagcgatggttggaggagcacaagtgctgttgccggtcatgtcgttgaatgtctcaaaggggcactcattaaaggggagtaaatttccactagtggaaaaagaagtttccactggtggaaagtttattttccacgggaggaaagatatctttccactggtggaaaaccggcgtgtaccaaatagtcgcctgacacacaataagaagaataaacaaaagcgcctgcttattgtgcaaagggcccattaattcgaacttgttaataaccgaacgtagcaatcggta

SEQ ID NO: 434 - DNA (genomic), 453 bp, PORYPHYROMONAS GINGIVALIS; double-stranded, circular
  misc_feature 1...453
  hypothetical: NO
  anti-sense: UNKNOWN
gctctttttggcaccggctacggtctgatcgaatttggatttctgagccggagcttccgttgcgggcttcttttttttcgagcgaaagaagtaatcgctctgtgcttcagccttgaaaacgggcaggatgcaggcgacagccatgcacgcagtaaagattcttttgttcatgcttgattatagggtttgatttatgattgatttttcttctgtcgtagcaccacagaggcaagccggctcggctcccgtgtatgccaagagatcggccggtgctatccgaagctgtaagcctcgcacacccgcgctgacatatatataagggaataccatgcaagtatgatggatataggatggataagcctttttcatcccgatgggcgaacagccggcacggatatacccccgtgagcggaagaagctcgctctgnctgatcattttccacgcttttgttg

SEQ ID NO: 435 - DNA (genomic), 1823 bp, PORYPHYROMONAS GINGIVALIS; double-stranded, circular
  misc_feature 1...1823
  hypothetical: NO
  anti-sense: UNKNOWN
ccttgtattcgcagagacgatcggccgcaggttcgtgtcgtagacgccgtatcgcagcgttttctccgccggtctattcgtagctgtgcttcgttgcggatcagatcggccgggtagcccagtacatcggtcagataatggacaaagtgctggcgcacccactcctccggcgtcagagccacatagcgacgccgaatgctgtcgaaaatgaacatggactcatcttcttggtgaatacgatgttcgtaagggggaaggtttagttgaatcatcctatctttgcttcgctcccgaatcttagaatttttggaacgagtgttacaaatataggtctgttttcatgaaaacgaagcaagagatagttgagaactggttaccgcgatatacgcagaggcagctgatcgatttcgaaccgtacatcctgctgacgaacttttcgcactatctgcatgtcttcgccgagcactacggggtacctatcgtcggagaacatacctccatgccgaatgcttcggccgaaggcgtcaccctcatcaacttcggcatgggtagtgccaatgcggctaccatcatggacttgctctgggctatacaccccaaggctgtgatctttctcggcaaatgcggaggcctgaaactggaaaatgctttgggcgattacctcctgcccatagctgccatacgcggcgagggtacgtccaacgactatctgcccgaggaggtgccctctctgccctcattttccgtactgcgagccatttcgtcagccattcagaacaaaggcaaggactactggacaggtacggtctatactacgaaccggcgggtctgggagtacgatgagaagttcaaggactatctgcgcagtacgcatgcaagcggcgtggatatggagacggctacgctcatgacggtaggatttgccaataagattcccatgggagcgttgcttctgatttccgacagacctatgttcccagaaggtgtcaagacggaagagagcgatcagctcgtaacggacaactttgccgaagagcatctgatgcttggtatcgatgctctcgaaatcattcgggagaacaaatcttccatcaagcatattcgcttcaactggtaatactcccccctcatctctatggcctcctattccgatattgtcgattctgtacgtaagtgccaattctcgccactctatctgctggccggcgaagaacccttctatatagacgagttggccactctgctggagacgcacgtggtgccggtagatgaatgggacttcaacagggttatcctctacggcgacaaaacctccgtagccgatatagcgaacgaagcgcgccgtttcccgatgatgggccggaggcagttgatcgtcgttcgggaggcgcagttagtggacaatatcgacttgctcgaagcacattatggcactttccccgatactacgattctggtcattgcctataagaagaaacccgataagcgaaaggctttctatacgaaggctgaaaagttcgggaaagtattcgtgtccgagaccatacccgactataagatgccggacttcatcctgtcggctgctgccggcaagaaactgagcgtatcgcccgaagtggcatatatgctggccgattacctcggcaatgatctggagaagttgatgaatgagctggacaagctcattctcataacacaagatagtaggggagtggtcacgtccgagatcgtggagcagcatatcggagtaagcaaatccttcaataatttcgaactccttcgtgccatagtcaatcgcgaaacgggcaaaacctttcgcatcg

SEQ ID NO: 436 - DNA (genomic), 990 bp, PORYPHYROMONAS GINGIVALIS; double-stranded, circular
  misc_feature 1...990
  hypothetical: NO
  anti-sense: UNKNOWN
agaaaggctggcgtctgctgctatcttccaaaagccatacgctccttaacgaagaggacttcttcacaaaagatgagcgcatcgggatacgcaaagattatgaaggagcaacgaacgatgatgctttcttctgtcagagatactatcgcttcaaaaatttcaaagaggtagagggcgaaaagaccaaggtgtgcaagcaaccacccgtacgagagcacgacttctgctttgcggtgcttttggagacccacagggatataaaacacgaagagttgaataagagaatcgtctacctcggtggagaacgacaaccttttcttatggatcttatggaggtaagtgaagagaccttcaaactcaacattgagagttctactcttacgagcgatgagaagcactacaccgtggtacttctatccgatgctatgattgaacctaagctccttgagggggtaaaatttgcaagcacggaggtgaaagactttgcctgtttgctcactcatgtaggaacacgcaggttctacaacaagaagaagaaaagagaggaacagaacatcgaagaagttgaaacggctctaagtcaccaacatgaactatacgccagaggttccgtgttttacttcgatactaaagagcaagcaaatcaattctgtgaggacctcgagaaggtccccaacttccataccatcggctacaatcatgctatcatcatcgaaccaacaaaaacaaaaaaataacaacaatcagaatatgaaaacagcagcttatatgatccattgccttaccaatatgcatgtgggtaagggagatgccacctacgaagtggtggacaaatgtgtacagcgagatgtaaccacagggatgccctgcatctactcctccagcctcaaggagctttgagacagttcttttcgaaacaaggctttgccgagcttaactattgtttttgggaagatcagagcagggttagaaaaatatggcatgagaaga

SEQ ID NO: 437 - DNA (genomic), 966 bp, PORYPHYROMONAS GINGIVALIS; double-stranded, circular
  misc_feature 1...966
  hypothetical: NO
  anti-sense: UNKNOWN
ggacgattggaatacaatatttatagaagtgcctatcagcacatttgctccggtcaagacggtcaatgacctcttgcgacctgagcaccaaccctgtcagagctaaaataatcaacccataataaacaattccccaaaaatcttttaaacaacaatgacaaacgatatcttgcagcgtcttgcgtctttgcgcaaagtcatgagtcatgagcatatcgatgcttatatcatcccgagttcggatgcccacctaagcgaatacacaccggaacactggaaaggtcgccgttggatttccggtttcaccggatcggccggcacagtagtggtcacagcaaataaggccggactatggacggacggacgctacttcctccaagcaggccaacagctcgaaggcacttctatcgacctctacaaagaaggcatccccggaactccctccatcgaacagtttcttgccgccgagctgaaagccgggcaaacagtgggtatagatggacgttgctttccggcaggtgctgcctctgcaaccgaatcggctttggatatatacggcatcaaactaaggactgacaaggatcttttcgatgaagcatggcgagatcgtccagaaatccctcgtggagagcttttcgttcagcccgtgaagtatgcaggagaaagcgtgaaagacaagatcgcacgtgtcaataaagaactggcgacacaaggtgccaatgccactattatcaccatgttggacgaattggcttggatattcaatcttcgtggtagagatgtggagtgcaaccccgtaggagttgcttttggttatgtatcggctcgagaatctgtcctctttgctttccctgagaagattactaaggaggttcgctcagctatggaagaaggcggggtcaagaatatgccctacgaagccatatatgaatatatcccagcactacctgccgaataaagctgctt

SEQ ID NO: 438 - DNA (genomic), 4337 bp, PORYPHYROMONAS GINGIVALIS; double-stranded, circular
  misc_feature 1...4337
  hypothetical: NO
  anti-sense: UNKNOWN
gagatgcagatgttacctcacacatgggcgcatctacggtatgcaaggtcgctgggagatttccagcaaggtatgttcgaagcagcttgcagaatgtgatgccgtggtacaacctggccaaagcaatacgtggggagccttgagcctcgaccacgtctatgaattcatgggaggcctcacgctctctgtccgccaagtgacgggcaaagatccggaagcatacttcaacgacctgcgcaatcgccacaagacgcgcgtgcaagagctgaaacaagccatcggcgtcgaagccagaaccacgatcctcaatcctacttatatccaagagcagctcaaagagggacagaatgctgccaacggcattgccgaaactatccgcaatacctacggctggaatgtcatgaagccttcggccatcgacaaggaattgtgggatgacatctacgctacttatgtgaaggatgagaagaatctcggcgtccacgaatttttccgcgaaaacaaccctgccgctttgcaggaattcacggccgtaatgatggagaccgcacgcaaagggatgtggaaagctacccccgaacagctaaaggctattgccgaattgcatgccaaatccgtggctgaattcggagccggctgtagcggattcgtttgcgacaatgccaagctgcgcagcttcatcggcgaacgcctcgatgcaagtgacaagaaagtttacgaagaaaaggtagccgatgctcgcgaagtatcgatcaaggatgccaaaaagggacggcgactcaagaaagagacccgctcgagtgaggatacctccagccctgtcacctcttacctgctgcctgcaggagtagcccttgtggtgataatcctgatactcttcctcattgccaagcgcagaaaagggaaagaatgagagaagtcctgctgactatagccttattggctacgctcaagtatctgttcgaggagggagtacataattccctcctcgtccgttgcttgcatgcggcggtctacgcggctttcatcgcactcgtacacggactgacgcagcacgtcagccggatggaagtcgagaccctcctgtactcgcccgaagccctgcgcaatgtctctctggccgtcatggtggatctgctgtacgtcgtatatatatgtacgcaccggccctcctccttccgcttgtaccgcacctgggtgcgccatctgcccccgctcctgttcttccccaccctcttctatctgcgtctgagtctgttctacgtcctgccgggttattcattcgttggagtttccatcgtgatggccctcatagtggcagccctgagtataacggctccctatctgtggagagcactcggactcaagcgagaagccttgcgagaaccacttgttctactttcgctctgcacctttgtcttcgtcattgcagccggagtattgcaccccgactccgcggtgcgaacagccggcatcactaccgactggtggcaggcgctctatctcttcctgatcgtcttggcaggtgcctcgatcggctattttgcccctcgcttgtgggctataatcagaagaaaaaacaactgaaaaaaataatcatcgaatcggaccggatcctcatcccacgccgaaccactcactaacaatactttcccaatgaacttcttgtccaacgtcatgttttgggtctccaacggcctgttggtaccggtagtcgccggactcatctatctcttcatcaaatcccttctcctcctcggcaccctcttcggcacgtggcagagctaccgccgccggcaggagaccttcgcctgcatcatcgaaaacaaagccggcctcgacaccgaagccctcagagccgaagcggccaaacgcccccacgctccgttcgaaaatgtgctggccgaagtcctcgatgcagattccgcccgtcgcaatctgctcatcggtcggtacgaactctctcgtgaacagcgtctgagttcggccaaggtacttaccaagttcggcccgatactcggtctgatgggtacgctcatcccgatgggcccggcccttgtcggactctccacgggcgacatcggacagatggcctacaatatgcaagtagcctttgccaccacggtcatcggtatgtttgcctcggctgtagggtatatagccctgcacatcgtgcgcacttacaatcggaacgacctcgtttggctcgattacatcaacgaaaaactctcctgatcgccatgtccagaagacgcttccacgaagaagacacggatccttcctcacttgtatccaacctcttcgacgtagccatggtctttgccgtggcactgatggttgccctcgtcaccaaattcaacatgaccgaagtcttcagcaaggaagactacacaatcgtcaagaatcccggcaaggacaacatggaaatcttgatcaagaaaggcgacaaggtggagaagtacactccgtccgacgaatcctccgatggagccggcagcaaaggcaagcgcgtaggtgtagcttaccagctcgaaagcggcgaaatcatctacgtgccggaagactaagacggagaaaccggctattatcatccgccctcaagcccaaaagctcttttttctatttcctccggccctgcgaaagctcttttcgcagggccgattttttatatccgctccccttccctctctctctgcatgttcttcagactaatagcttttgcttggtcctttgcattgtatgagacttttgcacaacaagcaggcacatttgttcattcttctgtttgcttggcagtcatacacctgcttgctatttgatctttcccggagatacaaagaatgaacccatacgagaggatattatggtctctcatgagaggatactatggtctcatatgagaggatactatggtctcgcatgagaagatattatggtctcacatgagaggatactatggtctcacataagaggatactatggtctcatacgagaggatactatggtctcatacgagaggatactatggtctcatatgagaggatactatggtctcatatgagaggatactatggtctcacatgagaggatactatggtctcacatgagaggatattatggtctcatacgagaggatactatggtctattgatggaagatgctatctgctctgtgtcggatggcagattcggggagtgggaggttccgtgtgagctgtgaaaccgatagatgtgtataggaacagtttttcgacaagagggcaatcgaacctttttccatttctttttctgattcggttatagtcaatgctccaacaagagtttgatcgttaagttcttatgagagtcagcaccatatgcttatatcgaactcatgtaatgaaagataatgtctataaaaacaaatccatcagcaaggccggaccttgctgatggattagaaaaaactgtcgttgtcctaagacctgtaatgcttttacaggacaagacaatgccccgactatttgcggaatgggggcttcacgatctcagccttgagttgacgaccgcgtaccatgatgccaagctctgtgccgaccttgttgaactccgtagccacatagcccataccgatacctttcttaaggcaaggagacatcgttccggaagtaacctctccgatgatttgcccttcggcattggcaatttcatagtgctggcgaggaatacccttgtctttcagttcgaaggcaacgagcttgcgcttgagacctccggctttctgctcttccatgatcttacggctcggcatatccattttgtcgtcggtgaacttggtgatccagcccagcccagcctctatgggagaagtggtgtcgcatatatcattgccatagagacagaaacccatctccagacgaagcgtgtcgcgagcaccgagtccggccggtttgataccttcgggcttgccggcttcgaagagggcatcccatatcttctgagcgtattggggatagaaatagagttcgaagccacctgctccggtataacccgtagccgaaataattacgtcggggcatccggcgaaagagcctactttgaacgtatagtaagtgatctcgttcaggtcgatgtccgtgaggcgttgcatcacttccgttgctttcgggccttgtacggcaagttgggcgatgttgtccgaggcattttccaatatggctcccatcgtattctgctgccggcaccaggcccagtccttggcgatattggcagcgttgggtaccatcatatatttttcctcttcgtagcgatagagcaggaagtcgtccactataccaccgtcgttattggggaagcagc

SEQ ID NO: 439 - DNA (genomic), 536 bp, PORYPHYROMONAS GINGIVALIS; double-stranded, circular
  misc_feature 1...536
  hypothetical: NO
  anti-sense: UNKNOWN
cggctcgcagatgcttagcgccaaggcggtaaagagccgcagcggaaccgttatacagcagggaatagaaatgagcattattggccggattgtccatcagggcaaaatccagctcatgcccggtacggatcatccaacgggaatcggaggctttgagagggaacgtcttctctcccaacaaattcagtgtccatcctccataacgaaggggtgacaaataggtgtcgcgcgttatgcttccgccaccaccgaccatataggcagaatgaatgcggtaggcggactgctccgtgggcaactctctactcgaagaatcagttgcaaacgctgtattgctaccgtgggaagaatcctgcccccatgccaacaatccggtgagtagcagaagcggcaaaacaaatgcgtatcgtctattcgttttcatcgtcgtcgaattgcaatcgctggatacccaagagttcgtctcttatatcttcatcggaagcaatggcttcgggtgcaacctcggcgaagctctcgtccggatcggttgtttc

SEQ ID NO: 440 - DNA (genomic), 5659 bp, PORYPHYROMONAS GINGIVALIS; double-stranded, circular
  misc_feature 1...5659
  hypothetical: NO
  anti-sense: UNKNOWN
ttccgaaatgcaacgaggatatagtcggcatcttccgtctgatactcttcggtaagcgaacttcattggcttcgatctctgcatacttcttttggaagccggaggttgttctgctccataacggccgaatcaagctcgagagaggtaatgatattcggctgacgacctccttttcgaccgagagttgcccacgggcattgtttgcggatttcatcttcggtacgacgctttttgaacggaggcaatatcaccttttccatcatctgaccgatgataccgtcggaaaggatgagtgcaggattgcggtacttgaatgccagctccagtcccagaccaacgaagtcaaccatctcttgtacggagttgggtgccaatgtgatcagacgatagtcaccatgtccaccacccttgacagattggaaatagtcggcctgtccgggttggatggttcccaagccgggacccccacgcataacatttacaatcaagcagggcaattcggcaccggcacaatagctcactccttcttgcttaagactcatacccgggctggaggaagaggtcatcaccattttgccacagctggcaccgccataaaccatgttaatggcagcgacttcgctctctgcctgcaagacaaccataccggtcgtatcccatggatgctcctccatgagcgtttccataacttcagactgcggagtgataggatagccgaagtagccatccacaccgttacgtattgccgagtgcgcaagggcttcattgcccttcatcagccttatttcttctgtcatattttttctctgtttttgttacaatttcactttgtaaaccgtgatacatgcatccgggcataccgttgcacaactggtgcagccgatacagctttcgggatctttcatataagagtaatgatagcctttgtcattgacttcattcgggtgtagctccagcacttttgtcgggcaagccactacacatagattgcaacctttgcaacgctgggtattaacgaccacagctcctctgatttttgccattatagttatctttttaataaggacttcgaatacctaaaagtgagtaatcttgacgcctcaaagataggtattctttccctcctgatacctataaagacggttttttcgatcgtttacgtcttttttgtcgggaaaatgttctttagcatgttttggcctcgtgctgttgtgatgaagtcaatccgagataagactctttcaagtcgaagtcgcctatatcacccctatcaatcagggcaatacggtgcgatcccccagacgatgcgctaactcgcttttcatttcgttcatgctgcgcagttcgttcattatttctaattgcaattcgatgtcgccggctttttgagcttgtgcgatttctttttgcaaagcacggatttgtacctgaataaaaacatttttgatggtgagaagttcgcgttccactcgcatctgaaggtcttcttccgcattgctctcatcccctttcccatagtgaatacggctcaatgcatagcggttggtcagtagctcgactgcgatatgactgatctgtgcattggggtgatctctgaaatatttggctgcgacaaaaccactgtcgaacgattgttcggcagcctcatcgagaatctgcctaaacacatcagtaccaatatccactccatccgcattcaagtctgatttgatgtaatatgccaaggcaacctccgatggagtctgcttttccgctccttcttcatgcctgtatatgaggagttttctttcgccgtagcgaatgatcagacggagtaactcctcttcgtatttggccggatagtaaggttgctccacctccgctgaacgattatcggtaggagtttcggcactatggttttccgcacctacgagattgtcggaatcgttttttctttcagagccattcgccggctgttgggtggcgggttgcggggaggagtacgtactcctacggaacctcatcttttggacttcgcgagccagcagtcgctcatccatactaagcgtttggcctgtctcttggacatagacacggcgtgtgatgtcatcggggatcagagcgatactgccgataatatcggtaattagctgtgctcttcgtatggggtcacgctccatatcgctcagatagagctgtgtcttgaagcgaataaaatccgtttcatgctgctcgatatattcttcgaactctgctacggtatgattgcgagcaaaactgtccggatcttctccatcgggcaggagggccactttcacgtgcatgccttgctccagtagcaggttgatacctcgcagagctgccttgattccagccgcatcaccatcgtatagaactgtgatgttcgaagtaaagcggtgtatttggttgatctgctgctgtgtcagagctgttccggaggaagccaccacattttcgataccggattgatgcatcgaaatgacatctgtataaccctcaacaaggaagcacttatctcggcgagcaatctctttcttggccaagaatagcccgtacagctctttgctcttcgagtagatgatgctttcgggagaattgacatacttggcggccttgtctttctttcctaagattcttcctccgaaggctacgatcttgccgcttacggtctgtacggggaaaatgactcgcccgcggaaacggtcatctaaggccttgctgtcttcgtatcggatggaaagccctgtgtcgactaagtattcgggcttgaacccttttcgtatggcttcgtcgctgaaagccgacctcttttcaggagcatagccgagttggaacttctgcacagtctccggacgaatacctctttggcggaagtatgtcatcccaatggtctggccttcgatggtattgagaaggttgtttttgaagaagtcattggcaaactcattgagaatgaacatactttctctatcgctcttgagtttcttctcctcatcggtcagctcccgttcgtgaatcttgatcccgtacttacgtgccaaatagcgcaaggcttcgctatagctgagctgttctattttcatgatgaaatgaacaggtgagcctccttcgccacaggcgaagcatttgcagaggttttttgccggcgacacagagaacgaaggattgcgatcgctatggaaaggacacaagccgaggtagttcactccacgcttacggagcgaaacaaagtcgcttacgacctctacgatattggccgcatcgagtatcctttctcgagtcagatcgtcaatcatctcatcctatatactctattacatataatgtcgcagatgtgtcattccattccctgcgaacggagataggctatggccttctccatatcctccggcgtatcgattcctatcgtactctgctgtgtttgcagcactcgaatccgatagccgtattccagccagcgaagctgttcgagactttcggcttgctctgccgtactttgtggcagtgaggttatcttgcggaggacggtcgggcgaaaggcatagatcccgatatgcttgtagtaagtatgccgacggcaccaagagtcaggctgtacccccctgagatatgggataacggagcggctgaaataaagggcatagcctccatgatccaatacgatcttcgggctgtttggattgttcaaacgctcgaagcttacgtcagacgagaaaacttctgctaacgtagctatatcggtttctggtttgtcgaaggccgaaatcagcagatcgatctgttccttttggataaaaggttcatcgccttgcagattcaggacgatcttttctccccgacctactttgtcgaatgcctcccgacagcgttctgtaccactactgcactctggggacgtcatcaccacctctcctccgaagtcctccacggcctgacggatacgttcgtcatcggtggctacgacggcccgggggacgacaccgactattcgctcatgtacccgttggatcatagacttgccaagcatatcggccagtggcttgcccgggaatcggctggaagcaaatcgagccggaatgatggctattacctctgtattcattctcctttgataaagcggagataggcttcgcagttggccggcagcatttccggcaggcgaggattgtaggaatcgtagcaggcatggtagccggtgaatcgagcgcgcaggaaagcagctatcccgtcgaatacattcaagtagcttcgcagcgtgtggcattgctgtgctccttcggcaaaagctgatttgggtgatccgcaggagactgctgcacagatttctttaccctccatcttgtctccaccggcaccataggcccagccctcagtaaagacctcgtccatccacttcttcagcagatagggagctgcataccaatagagggggaattggaagacgatgcggtcatgagcctccagcagggcttgttcatgtgctagatcgatttgtccgttcggatactgttcgtagagatggtggatagtggctgcaccttcgatggctttggcccaagccttgttgataacggatttggtcaaatcggggtgaacgactattacgagcgtttttttcattgttgaaaaggatattactaagtagtgtgacgaatccccaaaagagaagtctcgaattggaaagaggtctcattttaggacttcaaagaaacaatttataagccaaaaaagcaagggagatttctccgagaaaagctgtttttccgtcctcttgaatagaagatagaccggaattgtatctatggcttgagattctgccgaggttctgctatatcggcatatgcaaatgcaataccatgatcttttacaatctatgcaggcaagcaattcaacgtgtgtaggtatgaatgctggagtctttagcggatggaaggtagttgaccccataccagcagatttgcaggaaaaggaaactgacgattagcaataccaaagaatgggcaaaagctcgaggacgatggagccggtgatggatgtagagcaagtagctgaatacggttattgcagcccatgtttctttcggatcccaattccaataggtgccccatgcaagtttggcccaaatagcgcctaatagcagtcccgtcatcaaaaaagcaaatcccgtgtagaccagattgtcagtcgtatgcatcatgacttttgcattcacctctttgtgtttgcgcttgcaaaagaggaagtagccgcctacgagcagtgccgcccccagcatggcatatgcaaagatgtaggagattacgtggggtacgaagaacggactttcgagagccggcatcaatgtcttgttgtggatatccggtttggctatgtttataatcatgaagaccgtggacaagacggtggcaaaagaaaggatccaccgatatttccatcgtatataaatgataaggcctgcaatgatcacaaaaaaagaataccaaagtcgggtttctcccatcgttcttagaggaggtcgttccagagaatgccacatgcctccgataaaaaacatcagtacncaagctgctgcgatagcgatgcaaatagcccatacccgacgttggtacaaagcgaatagagctgacactataagcagtagtactgctggtatcgcaaa

SEQ ID NO: 441 - DNA (genomic), 2758 bp, PORYPHYROMONAS GINGIVALIS; double-stranded, circular
  misc_feature 1...2758
  hypothetical: NO
  anti-sense: UNKNOWN
tttgcgtcggtttcgtttggtttcggccagttggcggatggcctgttcgatatgacctcccgatttttctgccagctgaagcacttccattttttccggtctcttccgttgtatagcagagatacttctttcggccgaagacttcgggtggcatagacagccgattgcgtgccgcccagcccgatccagacctctttgtagagtctggacggatcgttatccatattgatggacaggatctgcgacttctccttatcggtcagcccgaggaggttctgtatctggtcgaatttgttggcatacttgcgctggtcgagaagaatcttgcaatccgaattgttgatgatgctctcctttaccaccggcgaagagatgatgtcgtccacctcctgcgtcaccacgattgcctccccgaaatacttgcgcaccgttttgtacatatacttcaggtagtcggccatattggccgaggcgatcgctttccaggcttcctcgacgatcagttgtttgcgaacgcctttgagtcgcctcatcttattgatgaaagcctccatgatgatgatggttaccacggggaaaagttcccggttttccttgatggcatcgatttcgaagacgataaaccgcttcgacaggaggtcgatgtttttgtccgaattgagcaggaagtcgaaacgaccgccccggtagtactggcggagcgtagtcagaaagttgtcgatattgaaatcttcccggctgactttgatctcgcggttttccagttccggccggtaggtatcgcgcatgaattcgtaaaacgtattgaagctcggcgttatccctctgtccgaaccgatcaggcggatataggccgagacagcgctgccgagctcgcccgattcggttttcgatattttttcctcttcgcttttccagagcgtcaaaagcagcgttttgatactgtctttcttttcgacgtcgaacaccccgtcatcggtataaaaaggattgaacgaaatcggctcctcttccgtataggtaaaatagatgccgtcttcacctttcgttttccggtggatgagcgaacaaagtccctggtaggagttgcccgtatcgaccagcaacacatgcgttccctgttcgtaatactgccgtacgagatggttcatgaaaaacgattttcccgaaccggacggtcccaggacaaatttgttgcggttcgtgataatcccgcgtttcatcggcaagtccgaaatatcgagatggagcggtttgcccgtcaggcggtcggacagtttgatgccgaagggtgaaagcgagctgcggtagttcgtctcggccgtaaagaagcagagagccggctcgataaaggtgtagaatgtttcttcggagggaaaatcgcccgcattgccgggcatgcccgcccaatagagcgtagccgtgtccgtcgtattgtgacggggacggcactccatcaaggccagcgccgagcctacatcgtttttgatctgccggagttcttcccggtcgtcgctccatgccagcacattgaaatgcgcacggatggaagcgagtccctgggagtgcgcaacgttcaggtattcctcgatccactcgcgattgatctgattggagcgagagaagcgtgcaagtgaaagcatgtttcgcgcctgtttctcgaagcgcttgagattttcttcgctgtcgtcgataaagaggtactggttatagatatggttacacgggagcatcagcccgacgggagcggcaaagctcagccggcagtcgctgcgatcggtggagagccgttcgtaacggccgtccgttgcgacggcagcaggcagatcgtcccgtatcggacaaggtatgcaggcagaggatttgatccccgatccgcacttcatcggcgccgagccggaggtcttcgagcgtgcctgccgcatcgtcgcgtaacgagaggtaacggtcgagcaagccacgcttgtcgtccgtgcctgcgatctcatccgccgaaagacgtctgaggcgcatatagcccgaatcgttgatgatccgttcgaactgatcgacggcctccagaaatttcaggacggcatcccgctcccggacttccttcggcagaagggttccgcgacagagcgtcgagaaatcgcttcgttgcgccatgtgctgtttcgtcgttttcgtcagacagaggtagacggaatggtgcaggaagggacgttcgttgaaatgccgttcgtaagagcggtcgaggaacgagagatcgtccttttccaactccggacggtagcttttccgaataaaccagtcctgcttgtgcaggatgctgtaaacgggcaagaccttcaccgccttgtgccaggcggcatgcatcgccgcgtattcgggtgaggtcacggtaaagagttcgggcagttcaagagagaaagccacggtgatgtcggcatctttcgatacgatgcagccgttctcgatggccagcagcgggaacttctcttccagttcgcatttcttacggatatttctcatggcgtcggttcgtttgtcgttacagcccggacggaaagaatacggcggacaggacggcgagagagcaggtaacggggatgccggcgagcggctccccgtttcatcagcccgtgttctccgtacttgcggttcatcgcgaacgtttgccacaccacgagggtggcacccgatacgcccatgcccagacagagatactggttcatgccgcacatgtagcagatgacgacaaggatcaacgtcgcgg

SEQ ID NO: 442 - DNA (genomic), 778 bp, PORYPHYROMONAS GINGIVALIS; double-stranded, circular
  misc_feature 1...778
  hypothetical: NO
  anti-sense: UNKNOWN
aaatatgaagttagcatcgccaactttctcggaagtaagccatagcacttcctgtagatgaagtcaaatcctcgattatctatccactgggaaaaatctttccggaagcactgctggagttattcataaaattctacaagaaggtatctctacgaagcctaattctcccatgctcaacgaggaatattatattccggctgtggctttcttgatgaagtcgccaaaggtgtcctttgcagaacgaatacgactgaaagagcgatacgagctgatgctgcgcaatcgaatcggcacaaaggccgaggactttatctacgaacagaccaatggcagtttacatcgcctcagcagcagatttacgctcaacaccatactcgtcttttatgagccgggatgccatacatgttccgagctgattcgccaactgcatcaggatgattggctgcgtaatttggtagaatccaaacaactaagtattttattcatatatccggataatgataaaaatgcatgggtggccggtttgtccgattttcccgatttcgtggaagtaggaatcaatagcgatagcagtatcacagatcgacaactgtatgatatcaaagcctcaccaacgatctatctgcttgataatcacggatatgtaattctaaaagatgtacaaataggagttataaaagagtatctgaaagagaaaaaagaatactctctgcttacgaagtatttatgcattacagggaaaaaataccggagaatcttctttgcagctctgcagatc

SEQ ID NO: 443 - DNA (genomic), 848 bp, PORYPHYROMONAS GINGIVALIS; double-stranded, circular
  misc_feature 1...848
  hypothetical: NO
  anti-sense: UNKNOWN
cccctcgcatcatacgagtcaagaaaaactttttacacaacacctgatgaatatgcccaccggggaaacccacaagtctcccccttcttcctcgcatcgaggactgtccgatgccgaagtcttacatagccgagctacccacggctcgaacgaactgactccccgcgagcgcgaatcgctctggagcaagtttttcgagaagttcaaagatcccatcatcatcatcctgctcgtggccatggtgctttcgtttgccgtggcttgctatcactacttcacgggcggagagggcngtctccgtctttctggagccgacaggggtgctgctcgctgtcgtattggccacgggagtagcctttttcttcgagatgaaatccgagaaagagttcgagatcctgaatcaggtcaatgaagacatattatataaggtatatcgcaacggcatgatctgcagggtgctcaaaaaagaaatcgtcgtaggcgacctggtcgttctggaaacgggagagcaaattccggccgacggccgactcatcgaagccatctcgctacagatcgacgaatccagcctgacgggcgaacccgttgtaaacaaaaccactgaccggcaggacttcgacgcggaagccacctacccctccgattacatctgccgaggcaccaccattctggacggccactgcactttcagggtggaaaaggtgggcgacgccacggaatacggacgggtattcgagggtgcccgaccagacaacagcgtacagacgcccctgaacagacagctcgaccatctggccggcctgatcacgaacgtcagctatagcatagcagccttggtactcatcggt

SEQ ID NO: 444 - DNA (genomic), 582 bp, PORYPHYROMONAS GINGIVALIS; double-stranded, circular
  misc_feature 1...582
  hypothetical: NO
  anti-sense: UNKNOWN
atccccgacattttttgcagataggactttgaaagtaaggcctctttctaaatgaaaaacctacctttacagacgaaacgtttcggggaaaatatgatgtaaaagagagaatgaaaagaatcaatatcaccatcggctttctctttatatacttcgtagtgatgtccgtattgggatacccgcgcgaaaggatagctccggacggtgccgaccggctggtgacgtatctgttggtttgcgctttggagctggtcgtactcatcctattacggtgggtattgatccggcggtacaagatgcgcgagcgtcgccggcacgatatggaacagtatgcccgatacgatgaaaaacccgacgaatagtcacctaacgctacagtgaagtatgacgaacacggcacagctctatccttacatattcaatcccattcttcgaccggtcgtgtggggcggccgcaggatacgccctttcaagggaatggagcccgacccgacgaaaacatcggagaaagctgggagaatttcgcatgtgagcgaccattaattcggtcgttggcaaacgggccttctttgccggtaagac

SEQ ID NO: 445 - DNA (genomic), 796 bp, PORYPHYROMONAS GINGIVALIS; double-stranded, circular
  misc_feature 1...796
  hypothetical: NO
  anti-sense: UNKNOWN
cagaagaataaagggtaagggtaggtcaaaaaaggtattatagaatagaactccaaacgttttgcacaaaaccgacggagttcgttcgtttgtaattgtccaactcccctttcaagctttcctgaaaaatgagttctatccccttttctccaatgcgatggctaatttgtagagtgggtgctattggttcaacatgtctgatagactgatgaataatgaaggggtatgatggggctttttaatcatgaaaatctgcaagtttcttgctataaagataagaaaacttgcagatttatcaaaggttttcgcaaactaatcagggcaaccgcatcaaatctttagtagctttttgagatagtctatattcagagcagctttgaacaacctcttccgtaaggatagtttgtctttatgcccggatacaatggctaaagcaaactttctcaacgtgtttagattggtggctgaataatccttacgagctcgacaagtatcctccctaaaggttacatccaaatgccaatggagtcgattctcaattccccaatgccctcgaatatattgtccgattaactgacaatcctcgggtggtaaactgctgatataatactgcctatctatgcgagtctctccctctaaactactaatctcacgctccacttgaattaaacttctcaagccttgccattgactatattccccctcctcaaagacctctgaagctagtaatgtggtataaagtcctcttctcaatacgaccatgatctttctccaaggttcataacgatgacacctg

SEQ ID NO: 446 - DNA (genomic), 617 bp, PORYPHYROMONAS GINGIVALIS; double-stranded, circular
  misc_feature 1...617
  hypothetical: NO
  anti-sense: UNKNOWN
ataggggaatgtttggcccgacgtatatcagcaggtgggcaatctgctcggagtcgtacgccaatcgaacgacagagccatccctcaagccatcggccgctgcctcacctacttcggcgaatactggggcaatcggctcttggctgcagccggtgctctgcacgagctgcggtacagtgaggtgtataggacttgggaagaagaggagagggctgaagactgaccctcaagtactgccctatggcatatataacaatagaatcatggtagccagtatagataaagaagccgttgccggcatggaggcagagatattccccggcacgatccacctgatcgacaaaccccaagccatccccgaagccataaggctgctatcggccagtcgcacgatcggcttcgacacggagacccgcccttctttcgtccgtggcgcccgtccgtccgtagctctgatgcagatgtccacagaaacggactgcttcctcttccgactcaatatgatagatataccggaggaactgcaacagctactggagaatcccggcatactcaaggtaggactgagcctgagcgatgacatgacggtgatcagacggcgcaaaccgatcgaaccg

SEQ ID NO: 447 - DNA (genomic), 4570 bp, PORYPHYROMONAS GINGIVALIS; double-stranded, circular
  misc_feature 1...4570
  hypothetical: NO
  anti-sense: UNKNOWN
cagcagatcggactgaagaccaatctgctttattggggtacgacgactcccaatgcaggattggagtttcgcatgggaaagaagtggacactcgatgtttcgggaggttacaacccttttacattcagccaccatcgcaaactcaagcattggctcgtggctccggagcttcgctattggacgtgcgaagctttctccggccacttcttcgggcttcacggcatcggaggtgagtacaatgtaaatgatatcgacatccccatcggccggctcaaaaagctcaacaactaccgatacgagggatacgccatcggtgcaggtctgacctatggctatcagtggctgctgggcaaaagatggaacttggaggcatcgatcagcggaggattcgtccacttcgattatgacaaattcgaatgtgccaagtgcggcaaaaagatcgcggaaggcaagaacgactacttcggtgtgacgaaagccacactttcgctcatatacatcattaagtaataccttatttatacagacaagctatatgaaacagagtcgctatatcatcctgtcgtttctcttcggaatgtctacgcttgccgtgacaggccagacccatctcgggggcattaaggtgagcgagaagcacgtggtcaagaaaacgggacataccgccaacgtaaagatggaccttgatctgacggccataccggatatgaacagcaatctgctgatggtggttacccccattattcgttccaatacatcgaacgatcaagtcgctctccgcccgttcctcctgatggggaacagacgttatcgcatcatcgaccgtcgtatcgctctcgataagcaccacatctacaatcagcccgacaccaagccttctgcgatggtaaagcgtcgcaacggcaaggaacagagcatggactattctgccgctactccatataggccatggatgcgccactcatcaatgattctattggctgagaactcgggctgtgccgactgcccactcggatcagaagaaaccacacttacggacgacgctttggtgccactgtatgaagcggactatcaatacgagatcattgtacccgagggagagctgctgaaaaaacgcgaagagactctctccgctcacttagcctatcaggtagggaaatatgtggtcttgcctcagttcgacggcaatccggccgagttggcacgtatcgacagcaaactgaaagaaatcggaaacgatagcgatatcattttcgaaaagctctccatggtaggctatgcttcgccggaaggtggcgtagaatacaacgcgaagctctccaaggatagggcgcattcatttgcaagctatctcgttaacaagtaccccatcctaaaaagtcgattcgaatacgattggaaagggcaggattgggcaggtctgcgtgcggctgtaaccaagagcgggctctcgcaaaaggatgccatactggagatcatcgaccaaaagccggtcggtgagcgtacagccgcactgcgagctatcgatggcgggtctctctatgccacattgctctcggactattaccccccgcttcgccgaagcgagcttacattccatatcgtggtcaaaggatttgagttggacaaagcacgtgaaattatcaagacacacccctctcgtctgagtctggcagaggtttacgccgtagcgcagagctatccggaagggagccacgaacgctacgaaacgtggacgatagcagagaaaactttcccgaaagcgatagagccgacagccaatgcggctataatagaccttcgtgccggcaggtatccgcaggctctggctcgactcgaagcacgcaagagcgaacccaaactatggatgctgttgggcttggcatatgcctacagcgaaaaatgggctgaagccgagagctatcttactcgcgctgcgcagcaaggccggcccggagcacaacacaatctgaacgaactgcgacgctatatgcaagacaatctctaaatggaaaaagattcttagaaaacaatattcacttttaaaacaaaaacgagatgaaaaaaacaaagtttttcttgttgggacttgctgctcttgctatgacagcttgtaacaaagacaacgaggcagaacccgttgtagaaactaacgctactgttagtttcataattaagagcggtgagagccgcgctgtaggcgatgaccttacagatgctaagatcacaaagctcaccgccatggtctatgcaggtcaagttcaagaaggtattaagacagtggaagaggacggcggagtccttaaagtagaaggaattccgtgtaaatctggagccaaccgtgtcctcgtcgttgtagccaatcacaattatgagcttaccggtaaaagtttgaatgaggttgaggccttgacgacttcttgacagctgaaaaccaaaatgccaaaaacttgatcatgacaggtaagtcagcagcttttacaatcaaaccgggctccaaccactatggctatcctggtgggactgcatccgacaaccttgtttctgctggaactcctcttgccgttactcgcgtgcatgccggtatctcattcgcaggagtagaggtaaatatggctacacagtatcaaaactactattcttttaaaccagctgacgctaaaatcgcagcccttgtcgcaaagaaagattctaagattttcggcaattctttggtctcaaacactaatgcatatttgtatggagtccaaacgcctgccggtctttacactccggatgctgcaggagaaacatacgaattggaggcgtctttgaatacgaattatgctgtaggtgccggcttctatgtgctggaaagtaaatatgatgcaagcaacgagcttcgtccgacgatcctttgtatctatggaaagctgctcgataaggacggcaaccctctcacggaaccagccttgacggatgctataaatgccggattctgcgacggagatggcacgacttactatccggtattggtgaactatgatggcaatggctacatctattcaggtgctattacccaaggacaaaacaaaatcgttcgcaacaaccactacaagatttcgctgaacatcaccggccccggtacgaatactcctgaaaatcctcaaccggtacaagccaacctgaatgttacttgccaagttacaccttgggttgttgttaatcaggctgctacttggtaatcgacccgtcaaacgactaaaaaactttcatagtttgtctatatcggaatacagggagcggggttcgctccactccctgtattcattctctccaaatcaaatagggaaatcccaatcaccaatcaaagaattattgttatgaacgacgctaagaaatatatcgtatcggtgctgatcttactcgtggccggaatgtttggcggatgtatcaaagaggactattccgattgtccccgtccgtttcgcctgaccgtcagggcttgggatgccgatatgcaagatattaccgaaaccggagccgtgcagcgcgtcgttattttcgttttcgacgaaaccggccgccgcatcgaccgactgatgatggacgccgcacaagtggctgcacgcaaaccgataccattggaatacgacggccccactacggtgtctttcgtggcatgggccaaccccgacgatcacatgctggaagaaacagccaatgtgcaaaacgtcaaagacttattcttcaggctttcctctaccgacggtatagcccaatcgcccggagaccttttttccggtgtactgacctgcccaatagagtacggctctatcgaacagggtacagaccaaactgtcgatatctaccgccgtacggcacaggtacatatcatcatacgcggctatcaagagtggctggaagctaatggccccagacaactgccagactatgccgacatccttttgggagaaactcccgacacttataccggcctggccgagctcatcggcaatgccgtccaataccgtcccgacggacagatacaaaacggggatttcatttctcccatcttcagagtttatcccacacttgatactactcctctgcatctcaaactctatgcatacggacaagaattgctgaatatcagcacaggttcggatggagtaccattcatacccgtcataggcaaaatgctcaatatctacatagacctgcgtggagcaaacctcaatgtactcgtatccgtcaccccttgggacgtagtgcaacaatatgcagaatactaatccgacagctattatgaaaatgaaatatttccatcatccttcgggactacttccacgccttctcctgttattgcttttaacgatggggcggtagcatgtaccaaggaagataatcccgatcagcccacctcggacgaagtggcaacagtaaagatgtcgcttgacgatgtcgaaatgcgaggcggagacctctacagtggagaaaatctgatcaagaaagtgcgcatattcgtctttcgtgaagggctaaacggcctttgggttctcgacaagcaaaaactatttgcttcggggca

SEQ ID NO: 448 - DNA (genomic), 2586 bp, PORYPHYROMONAS GINGIVALIS; double-stranded, circular
  misc_feature 1...2586
  hypothetical: NO
  anti-sense: UNKNOWN
ggcgattatttccttcgcgacaatttgtcacttggtatctccgttgcacacctgcgagtgggatggagaaacaattggacggccaacgttaagttgtcgatttgtcttctttagaatctttgtagaggacgttttttcgcaattgcagttttttcagtacacgtcgcttttctcaaccgttgagaaaatcttcgtcttggacgagggcgacgccgtagatggctgagaggcgatctcgcaggatggcggcatcgttgccgcgaaggctgacggtaagcctgcaattctcgacaaaatcctgcgagcggatggaggctccggcatctttcaccagtcgcatcacttctcccagcaaaggatattcgaaggcgatagtcagttcttcatacaggatctcttccttccggtcggctgcttcgagggcttcgcgagccgcttcgcgataagcaacgataagaccgctcgtgcccagcttgacacctccgaagtagcgcactactgcgacgaatacctgcgtaagccccaatgaggtgatctgcccgaggatgggtttgccggcagtccccgatggctctccgtcgtcattggatcgtgtgcgttcgcctttggctcccagcttgtatgcccagcatacatggcgtgcatcgaagtagcggcgacgcagatcggccacaagcgacagggcctcctcttccgactttacaggataggcgaaagccaggaagcggctgcgtttctccgtgtactgtgcttccgagggagcactgatcgtgaggtaggaatcttcggccatggttcaaaggagagcctcatctgtaccttcctcccgggcggcaaacttttcggacaggacggagaggagcgtactcatttgtttgatactggcgagcgtctcttcgctcacttcctttttctgcaagcgcagggtcagcagaccgtatatggcagtcaggcaagtctctatctctcccgtattgctccctgcactcttggctctaagctgtacgatggcagggagcacctgatagtagagtccttgataaatcatctctttggggtccgccatcagtcgtgagtgtatctcttccatttgcatgatggctatgcggacgatattgatatgcccctgctcgcgaacgccctcggtcagcatcatctccaccagctcggcataccagcggtctatctcggcggtcgtctccgtatcttgccggtattgggcaattacagtggcgcgaagccgctgcatatccagttcgttggcacgtataagatcctctatctgccacatgtagaggacgtactcggcgatattgttgcgccgtttttcccttgctatgatcatggtcgtttgtctcggatcaggccgttcagcaacgtttcgtccgcatcgttgggtgcaggctctatacccaacagcctgcatatgagcggatagatggtgatattcggcaggttttccaccctactgcccggacggaaatcgggtccgacagcccggagtaaagcccgcatttccggtgcttggttgtcatagccatgtgccgctcccggacgaacgtcttcatttattgcgaaaaagacggtggagcctatgtccggaatcacgaccagttcgcccaaacgaggattggtgccacagcgcaaacgcttgggcacctcccccttgcggtaaaccgatatatgtggaatggcccgcaggatctcataggctcgctcggtataggagggcttcgggtacaagtgggtgaaggccccggtggccatgtagaggaaactgtccgcaggcagataatgcgacagattgacacatttctcattttcgtacgtggccataccgtgatcggatactatgatgaagtcggtctgtgcggctatgggcagagagtccaaccgcttgcggaaatagccgaccacactgtccaaccgctctaccattgccagtgtcagcgggctttcgggcgtttggctgtgtccgatcatatccggctcctcgatgtaccacatgagcaagcgcggtcgctccttttcgggcagtccgagccacgcgatgacggagtcggcacggtcacgaaacggaacggtggaggagaattttttccaccgccacggccgatttccgttcacagccgtttcggatcctacccaaaagtagacaccggtacggatgccttggcgtgcggccgtattccaaaccggctcgccgccccaaaatccgggggtctccacggcttttcggtcggatatacgaaagatgcccagtagcgaatccacaaactcattggctacgataccgtgatgatcggggtaaagccccgtagccatgctgtaatgattgggaaatgtaagcgaggggaagcatggttggagcgacccgctcaatccctcctgtgccatccgatccaacgccggtgtacgtgcccgatcggtatagtccggtcggaagccgtccaaagacaggactacgacgtaccgttccgactgcttaggtgtttgtcggactgttctgcaaccgacataagagaaggcaagaagcagaaacaagataaaaggaaatagagataaatgctgtctcatttttataaa

SEQ ID NO: 449 - DNA (genomic), 1098 bp, PORYPHYROMONAS GINGIVALIS; double-stranded, circular
  misc_feature 1...1098
  hypothetical: NO
  anti-sense: UNKNOWN
attctcttcttctctctttcgaatggccagggaaagtcagncgaaaaagggaagggacttccctttaccctttattttccggctgcgtatcgnagggcaactcgcgtcctgcattcagagcttgaggttcatatccaccacttcttgtcctttgcggctgaaaatagcttcgataccgcctgccagatagtcgaaaggaatctcaatgaagggagaagcggctccgagcatcacgaagttggatgcacggacattgcctacctcatcacgggcgatgctgtccgcatcgatcagaacgtgatgaggaagagattcgatcttggagataactgacgtagtctcgggatagttcgggatgttgatgaacggaaccgtattggtcactacataaccgtcaggtttcaaataaggaagatagcgcaatgcttccatcggctccacggagaggataagatccgctcccccgatagggatcaggtcagagtaaatgggtgcatccgacaggcgcagaaaagactgtacatcaccacctcgctggctcatgccatgggtttcggcctgcttcaaatacaaattgttggtcagagcagccgaaccgatagctgctgcaatggacaaaatgccttggcctccgacaccggccaaaataatatctgttttcatttctttatttcctcctacttcaatggttattccttggcctttgcacgtttggcagctttggcgtcgcgagcatgcttttggatgcagacgcgacggggaatgatgacggatacaccttcatagttgatttcctcccggatgatgctgcatagttcgtcatgattcttgggtaccggcaacagctccctgatgtgatcggggatctactccgataccgcgacagatggcctctactttgccgtatgcagacgaatgctgacctcggtcatggagatggattcattgtccgagataatcaccgtaatgtgctattctcattgatggcatcgagaagacccgttattccgaatgagtgaaagtagagtcgccgattacagacacagccggaacaagccggcatnggcagcccttnggcatcgtgatagatgcaccatt

SEQ ID NO: 450 - DNA (genomic), 822 bp, PORYPHYROMONAS GINGIVALIS; double-stranded, circular
  misc_feature 1...822
  hypothetical: NO
  anti-sense: UNKNOWN
gatccggctgactatcgcccgctattatacgccttcgggacgtagcatccagaaaccttatgcaaaagggaatttcaaagcatacgaacaggaattgatcggtcgcttcaaacacggcgaatccatccacagcgacagcatccgtttccccgattctcttcgctacaagactctcgtcacggggcgcaccgtttatggtgggggaggcattatgccggatcttttcatcccaacggatacggccttgttcaacaagctgcatcgcgagctgctgaacaagggtatctttaatcgggctgtactcaaatatgtggatgcacatcgtcagaagctgcgccaacgcttccccgacagacagtcatacgccacgtttagcattcccgaagaactgactgaaagcctgaaagcatttgccgaagctgagaaaatcacatggagcaccgaactttttgctcaagccgaagagcttatcaagtgtcagctccatgcctatatcgcacgtgatattctgggggagaacgacttcttctatttcttcaatcgcatggataaggaatatataaaagcactcgatctcctcaatgatcccgacgaatacaaacgtctcctcggaaagtaatatttagcataaaaggggacaccggaaagataccaaacaaccgctcggttacgttagctttgtagaggattatgaaagagataagtagattgacagctgtcatattactcgctgtgggcttcgtacttgccaatggcagctgttcggatgacttcgacaaatatgccgagtctccggaagatcgtgccgaattttctgccgat

SEQ ID NO: 451 - DNA (genomic), 3227 bp, PORYPHYROMONAS GINGIVALIS; double-stranded, circular
  misc_feature 1...3227
  hypothetical: NO
  anti-sense: UNKNOWN
aggatcccccgccatgcggcgatcttatcctcggctcctatgggcatcagctttgcatgtgtgactgggtacataaggaacgcaaggaaattattgacatggggctgcaaaaaaggctgtgctcctcatacgagatcgcactgtcgcccgtcttgaaagagacaatcgcccaactggacgaatacttctctcacaagagagagactttcgacatccccctgcttatggcaggaacggagtttcagcaaacggtatggggcgagctgctgaatatcccctacggcaccacgatctcatacgccactcttgcacgacgaataggaaaccccaaagccgtgagggccgtagcccgtgccaacggagccaatcccatatccatcctcgtgccgtgccatcgggtaattggaagcgacaatacgctgacaggttacggtgggggattggacaaaaaggaattcctgcttcgtcatgaaatgagtctgccggtctaaagccttgaaagcctctcgaaggctatttatatttgagtatatttgcaagcataaaaccagttatataaaaacaaagtagaatatggatttcatctttcttcaggccgcaccacaagccggaggcctgttcggaggctcaagccagatgattctggtgctcgtgctcatggtagtaatcttttacttcttcatgatcaggcctcagcaaaaacgtcagaaagagcttcagcgtcagcgcgaagccctcgccaaaggagacaaaataatcaccgcaggcggtatacacggcaccatacgcgaggttcgcgaaaaagatttcttggtcgaaatcgccaatggcgtgaacatccgcatcgataaagggtctgtatatgtatctgctcgcgaagcggaaacagacatggccaacaagaaagactaagctgcataaaagcaatctatcggaggaactgacagagacgggtaggtattacgtccaataacacttggcataaggcaccccccatctttcagttcctcatcgttctccaccaaatccgctaaagggaatgaagctcaatctcctcaatgccgatcggaaaaaggggaaaagtatagacaaggcatccgctccccgttcacgccgtgggaggaacgtccttgtctttttcgcttttgtggttctctctgccgttttttggtttatgcagagtctgcaggatgtttacaccacttcattttcgattcccatctcctattccgagctgccgccggacataggagtctcaggcaggctgcccgaccgcttggacattatgctgaaagatcagggtatcgtgcttctgacctataagctgaaggggttctctccgatcaatatctccccatccaaagcgcaattgcacaagaaaaagagcatgcgactgaacaaatgggatctggtcgaactgctccaaaaacaactggagacctccacgaccgttgcagccatctcgcccgaagacatcaaagcgacattctacactcgcaaaaagaaaaccgtacccgtagtcataaacggacaaaccgtccccaaagaaggattctacgccttcgatcccatcttctcgccgagcgaagtgaccatatatggaagtgcagaagcgttggcgagtatcgggtccgtgaatacggaagagttttctatcgacggattggagagcgatttctccggtgacatagcgattgccccgatcgatgatatcgttatcgatccgacaaatatcagaatgcaagtgcgtgtagagcaactaacggaacaaacgttcgaactgccgatcataacgaagaatgtgcctgaaggcttcctccttcgtcctctacccggcaaagtgtcgatacagctcacactccccacatcgcactacaaagaagtatcggaagctgatttgcaaacagccgttttctatccgtcctctccggattcgctccgtagcgattcttctttgccggtagagttgatcatgaaaccggattggctcaagcactataagattaccccttcgcacgtccaattcatcatcgaacgcattcagtaagcagcaatgattaccattgggatcaccggcggaataggaagcggaaagtctgttgtcagtcgtatcctgcttaccctcggtatccccgtatacgactctgacagcagagccaaatggctcaatgatcacagccctgtcgtccgacaggcactgacgggcctcataggcagcgatctgtacgagaacggcatactcaggcgagacaggctggctgcggctatcttctcctccggcgatctcctcgaacaggtaaacgggatcatacatccggaagtcaaaaaagacttctgccaatggcgttcggagtgcgaatcggatctctgcgccatcgagagtgccattcttttcagctcgggattcaactccctgtgcgatacggtaattcgggtcgatgcccccgaaaagataagacaagagcgggcgatggctcgcgacggctcatcggcagaaaccatgaggcagcgtatgctcagccaagaaagagagcagtcattggccaaggccggagcagaccatacggtgctcaacgccccaccccatctacttgtccctcaagtcgtcagaattatagagacagtacgaacaaagagacccaatccgcccgatcgactttaggggaataagacaggtgcttccctgctctcctacccctcgacaggaacgaaatacttacttttgcagacagtcaaaaactgaaatacaatatcaataacagaaaaatatgttgcaacccatcctttccatatccggcaaatccggattgtttcggctcgtatcgcgcggaaagaatacgctcatagtcgaagccctcgacacgaaacgtagaacccccacatacccatcggaccgagtagtctcccttggcgatatttccatttacaccatcgaagatgatgtccctctgccggaggttatggaaacgatataccggaagaacgaaggcaaacagctcgatgctcctgctctcacgaaggacaacgactcactacgtgctttcttcggggaggtactgcccgaatacgacgtcgatagagtatatccgagcgatatacgcaagattatctcttggtacaatcttctggtggacaacggatttaccactttcctctcggataagaaaccggcggaagaagagacgacggaaaaagaatagcatacttcggccggggatcgtctagag

SEQ ID NO: 452 - DNA (genomic), 581 bp, PORYPHYROMONAS GINGIVALIS; double-stranded, circular
  misc_feature 1...581
  hypothetical: NO
  anti-sense: UNKNOWN
ggatccccttgcataacagttgtttgcttcgtgcctatctgtgaatggaagcgcgcaacggaaataccggactttccatacagagaggaaagggtagaaacagcaaaaagcagggtgaaaaatagtcgtttcatctttttgtcttatttgttgtggaaattatgattgataagcccttcttttcccttcatcgtaaatgtatagtcgtcccataaagggggggataagggatgactaaataatctttgctatcacggtctccatatctttccaaactaaaggcaatggaattttattgccctttcttcgattctttgctgtttttagtgttatgattatagcttcctgcaaaggaaacacattttttgcttttcacaaggctgataagtcttgatttttttgttttagaaatttatttcttcttggattttgctcgttggcattttatgctactctgtgataccactttatatcggtctgaatctctgcctgtgtggatgccagaaaggtctgattttctatataatcgtcccttaaaaaacccgaattaagccgagatgccatgggaataatggatatct

SEQ ID NO: 453 - DNA (genomic), 539 bp, PORYPHYROMONAS GINGIVALIS; double-stranded, circular
  misc_feature 1...539
  hypothetical: NO
  anti-sense: UNKNOWN
cggcgatctcgccggtttgtgtcaggtcgagcctgcctgtggcaacggtgatacgcgtattctccgtaacgcgcttcataaagagcaggatggccaaaagcagtcctatctctatggcaacggtcaagtcgaggatgacggtaagcaagaaagtaaccagcatgacgaggctatcgctgcgagggccgcgaccgatattggccaccgaacgccatccgctcatattgtaggatactatgatcagtactccggccaaacaagccatcgggatgtatgccgtcagaggcccgaggaacagcaggatcagcagtaacacgaaggcgtgtatgatccctgcaatgggagagcgtccgccgttgttgatgttggtcatcgtacgcgctatggctccggtgacgggaataccaccgaagaacggaaccactatattggccgcaccctgagcgataagctcggtattgctgttgtgctttttcccctatcacaccatcgggctacgcttggctgacaagcagagattcgatagcttccaacagggc

SEQ ID NO: 454 - DNA (genomic), 662 bp, PORYPHYROMONAS GINGIVALIS; double-stranded, circular
  misc_feature 1...662
  hypothetical: NO
  anti-sense: UNKNOWN
tccgtgtcgatgcgatccattcgaattttggccggagtaacctctccgagtatcttcttcatggcagccatatagttgttgatcttggtgccacctccattgagaataatgccggcgccgatatcttcaaggaggcctgagaggcgtaggatgttgaggtagttggctgtgatttcgtccatgcgagccttggccaggcgattgacttcggaggagcggaactctctttcggaaaatttgtcggcaaaggtcatgcggaatgatccgttggacttattgtcgttgatcatcgacacgtggttgagcttcatgttctccgcctcctgttctgtcagtcgcaggctggtcaaatcgcgtgtgacgttataacctcccatcggaagtacgcgaagcatggccaacagcctgtttttatagatagataccgatgtacagccggcacctatattgacgtagcaacatcccaatgtcagctcgtcgtccgagagcaatacctgtgcttcgcaaagcggtgtgacgaggatgcctgtcaagcgcaatcccagacgttcttctatggcgatgcggatattctgctttaccgaacggcgagcagtgatcaattggaagcgggcttcaagctcatgacaaaatactcccttggcctgtatctcctgtttccg

SEQ ID NO: 455 - DNA (genomic), 639 bp, PORYPHYROMONAS GINGIVALIS; double-stranded, circular
  misc_feature 1...639
  hypothetical: NO
  anti-sense: UNKNOWN
cggtatggggcaaggtgcccaaacgtcagggtacaggttacgctttcgataatactgccggagcacgaccgaaacaggacgtcggctttaacggacttacgacggcagaggaaaaagacttccctacatatacagagtacatatcccgcttggcctcgatcgtatcgccggatgttttgaaccaatggagtacagatcctttcagtccgatcaacgatccgggaggggataacttccaccactatagaggggcagattacgatgaggcacggaagtctattctcgatcgttataagcagtataacggagtggaaggcaactcggccgaagccactaacaacattaccggatacaacgtgtccagccgtttggtgccggatgtggaagacatcaatcaggacaatacgctcaacgagatagagaagtatttccagtacccgtgtggagctgcatccctctaaaatggttgtggggcaaaactatattgtcgattctcgcaccaaagaggtagagttgcgcaacggtaaaaaggaaacgataacctggtatcagttcaaagtccccgtgcgggaattcgagagaaagataggaggcattacggacttcaagaccattcgattcatgcgtggtctacctgac

SEQ ID NO: 456 - DNA (genomic), 608 bp, PORYPHYROMONAS GINGIVALIS; double-stranded, circular
  misc_feature 1...608
  hypothetical: NO
  anti-sense: UNKNOWN
cgtcccttagcaggctgaggcactccggtaaaaccggcaccgatcggctgtcgatatgcaagcaaacgtctgaagcctctgccagccccttggcatgtccgagcaaaccgaaacccgtaatatcggtggcaccccttatcccgtatttctgcatcaactccgcccctgctctattgagcaggcacatctgcccgatggcagcctcataaacttcactgccgataagccccaaacggtgggcagccatcgctacgcctattcccagcggtttggttaggacgaggcattgccctgcacgtacgccggcatttgtgaccagatgctccggatgcactatgcctgtaacggccagtccgtacttaggtatgggatcgtctatcgtatgccctcccatcgtaaaggcaccactctcgtctatcgtctgctgtcctccacggagaatagtncgccaagacctctacgggaatcccttcggaggggaacatggtcagattgagtaccaacagcggtcgcccttccatggcatacacattcgagagagcattggcagcagctatgcgaccgaaggtataaggatcggacaaaccgcgggaagaaatccggggtac

SEQ ID NO: 457 - DNA (genomic), 568 bp, PORYPHYROMONAS GINGIVALIS; double-stranded, circular
  misc_feature 1...568
  hypothetical: NO
  anti-sense: UNKNOWN
ggatcagtaccgatgaagaagagataagtcgacttgagcaagaagtcttggccttttataaagagattgaggcccaagcatcgttgctgaccgaagaacgcattcgggcagcctccgctttggaaacttctttgtgcgaatccttacgcaagctcaatatgcctcatgtccgttttgtcgttgatattcgctcgacagaatacggccctcacggagcagacaaggtcgtttttttgttttcggcgaataagcagatggagccggagccggtatcggagattgcctcaggaggagagattgctcgcctgatgttgtgtctgaaagctctcattgcagacaagcgttctttgccggccatcgttttcgatgagatagataccggcgtatcgggtgaagtggctgaccgtatgggagagattatggctcatatgggacaaggtatgcaagtgctcnccatcacgcatctgcccaaatagcagcccgaggggaacggcactactttgtctataaagatgaaacaggcgaacgggcacgcaccttcattcgtgaatgactccgaagagcgaat

SEQ ID NO: 458 - DNA (genomic), 318 bp, PORYPHYROMONAS GINGIVALIS; double-stranded, circular
  misc_feature 1...318
  hypothetical: NO
  anti-sense: UNKNOWN
gccttaacattgaacaatctaggtctattatacagcaataacaatgagctaaagcaagcgaaagactgccatcaagaggccttggtgataagaagagaactcgtaaaaaaaagtcctcaggcctacaatcaagacttggctatgacattgaacaatttaggccttttactcggcaaaaacaatgaattaaagcaagcgaaagattgctatcaagaggctttggtgaaatacagagagcttgcaaagaaaaatcctcaagtctataacccggagttagcctcagtattgaacaatctgggtgtcttactcaacgataac

SEQ ID NO: 459 - DNA (genomic), 578 bp, PORYPHYROMONAS GINGIVALIS; double-stranded, circular
  misc_feature 1...578
  hypothetical: NO
  anti-sense: UNKNOWN
ggcaaccactgccttcggatagcgttgcagtacttctgccgtattcttgggaagcggattgataaagcggaagtgagccaaagccactttcttgccggcattgcgcatacgctccattgtctcatagaggtggccataggtaccgccccaaccgatgatcaaaagctcggcatcgtctttatcgccgtgtacttccaaatcaggaatatcttgggcaatagcttgaaccttggcttcacgcgtagcgaccatcttggcgtgattctccggattggtgctgatggcaccggtcacatagtccttctccaaaccgcccaaacggtgctggaagccttcctgtccggggatagcccaatagcgaacgtgggtctcttcatttctgaagtaaggtctccatttggcttcgcccttatactgatccacgtagggaggacggatatcgggatatgattggggatcggggattctccatgcagaggagccgttagcgatgaaagcatccgttagcaggataccggtgtcatatgctcaaagctatcttacatgcccagaaagcagaagtcgaagcagtctgacgg

SEQ ID NO: 460 - DNA (genomic), 468 bp, PORYPHYROMONAS GINGIVALIS; double-stranded, circular
  misc_feature 1...468
  hypothetical: NO
  anti-sense: UNKNOWN
ggagaagcctcccccgatggagttcgagacaatggttacttctactacatgatggcgatagcccttatcggaggagtacttatgacccttttgatgctgctggccaaaggtcccttcgtgaccatgttcagtcgcaatagccccgaactggtggacttttactatagtatcgtccccttgttcgtcttcatgctcttttggtctgtcttcgaactctacgccacacaactgatgcgaatagccgtgcccaagctgatccgcgaggtagtgctcaggctgatgctgatcgtcgtttatctgctctatgcctttcgatgggtcaagtctggaagttttcatcgccatatttattgcagcctatgccgcatgtatgctcttgctgttggcttatatccggcgaatcggcaaggtcaatcttcgtcacaatcggggctttctgacaccggagctgaagcgcaattttctccg

SEQ ID NO: 461 - DNA (genomic), 1660 bp, PORYPHYROMONAS GINGIVALIS; double-stranded, circular
  misc_feature 1...1660
  hypothetical: NO
  anti-sense: UNKNOWN
ggcatccgtcggacgaagaagccaagtccgtggtcaagaatacatggttccatctcggtggtaatagttgcgagcaaatcgtattttgtctcaagcgtattgccgagccgtgtaagaagcatgtggacaacaacttcaaatccgctgcccaaggtctgtgtatccgaatttcttgctgcacgcgaaaaactcattctctatatcaaagaggccaagctgatcgtgtccaacgaaacggatgagatcttggatccgatgacttaccgcggcaaggacatcaagaaagagctaaagcagcttcgcaagacacagcttagccgcattcagcagggggcgagcagtctgaagatttctctcgtctatctgaatctcttgcaggagtcgcagcagttggtgaatatattggacgatctgatccacgccacggagaagctgttcgaccccgtagcccggatcggcacggacgaagaatttttcaactgacggccgatagctctgttttttcctcactgtgcatccccctgataaagggtcttccgaatacattaataggatgtaataacggaggatcagggataaataattgataaaagcttgtggaagagaaaaaaaatgccttactttgcaacccgattatgaccgctttatgatgctacaagcagtcctaacgaactggaacgataataaactaataacgaaatagcaatgtcaaagatttgtcagattaccggcaaaaaggcaatggttggcaacaacgtttctcactccaagagaaggacaaaacgagtattcgatgtcaacttgttcagaaagaagttctattgggtagaacaggattgctgggttgttttgaggatatcggctgccgggctgcgcctcatcaacaaaatcggtctcgacgctgccatcaagcgcgcggccgagaagggcttcttaaacgcataatcaagggagaattctgtcatggcaaagaaagtaaaaggcaatcgggtgcaggttatccttgaatgcaccgagcataaggagagtggtatgccgggtatttctcgttacatcaccaccaagaatagaaaaaatacgactcagcgtctggaactcaagaagtacaaccccatcctgagacgtatgacccttcataaggaaatcaaataataaagaggagatcagacaatggcaaaaaaatcggttgcaacatttaagaaaggtgatggccgtacctactccaaggtaatcaagatggtcaagtctcctaagacgggtgcctataccttccaggaagaaatggtcccgaacgaagctgtaaaagacttctttaagtaaggttttttccttttgaataatatagagtgcgataagcattctcagtgaagccccttctattacactataggggctttattttttatcgatcgatcaagattgacaatgaaaacaaacacttattccctgctatttgtctctatctctcttgtctttttgtcgttctttccagcaaaggcacaggctatacacccgaggattgaagcagggctgggtttgttgaaggaggggctgcctcttttctctataccttccataggctggctttttcgaatgacgagaaaactctgtatcgaaccatcggtcggctattatctatgggtagctccaaagcatcagg

SEQ ID NO: 462 - DNA (genomic), 2760 bp, PORYPHYROMONAS GINGIVALIS; double-stranded, circular
  misc_feature 1...2760
  hypothetical: NO
  anti-sense: UNKNOWN
gtccatttgcattggcctcggtaacaaaagctccgttggtgtctttcaccgtattcagaccccactcctgtgcttcgtcgtatttgttgctggccagggtaagaccggcttggagctggaaggacttgtatgcgaccttaccttccagattgagaccgaatactttggctccgctaccgttgatacgcgtgtagcgtttgatgccatcgtgctgatcaggctgctcctcgttggtgaatacatccagcaaacgagtatagaagccttccacaaggaagttggtctggacgttaccgaaacgatgatacatatcggcactcaaactgaatgcatgagaaatttcaggcttgaggttcggatcgttgaatactttctgtgcctcaccgcctacaacccctacgtgcaagtcttcatcgaatacctgcggtgcgcggaacccttttgcatatgtagcgcgcaggttgatgtccggattcacgttgaaacgcagtgtggtacgaggactcagaatcatatccttgacttcgctatgcttgtccaagcgagcgccaacaaggatgctccatctgtcatttttccattcgttctgaccgaataggctgtagttgttgatattctgatccaattcgggatagaggggaatggtattcccattggcatcctcgccggtctgccatgaaaggatgggcatcacgtcattgagttcatcacgcgtatattcggctccgaacaaaagttgcgaaggcatgaggaggaatttgtccaagtcgtagctgtactggataccgcccatatatgtcttgcctttggtcacgccataattattgccgtattgatcttgagggatagggtagccttccgtaccaccggggtggccattgacgtcaatctctccgatacctccgtaatagctcttgcgatttacgatctgtccggaagtataagcctggaagtggtgtttatagttggaagagaagagatcgtatttcaagtttccgctaaatacgctatggtcagtttgttcagctacacccactacgtgaggaggcaaatcgatacgatcgccaccacggcggaattcactgatcgtgtgaaactctcccgtcaatttgctgtagtcgctcaagcgcaaataagaatgcgctcccagcgagcgggcatctattttacccaattcggaataaccgtcattgttagcatcccaatggttgcggtaacgagcctgcccgaataccatggcaccggcacggttgtcatcgctgacgatggaggcattgaagttcgtgttgttatccagcttgctgaaaccggtaaagctcagagattcattgaatgtgaaagaattgtgagaaggttccttggtgatgatattcaccactccggcaatagcagaagaaccgtacaaggccgatcctccaccacgtactacctccacacgttcgatcatattggcagggatctgctccagaccgtaaacaccggcaagggcactcatgatgggacggctgtcgatgaggatctgtgcataacgaccatccagtccattgatacgaacttgattgaaaccacagttctgacagttgttctctacacgaactcccggctggaatgacaagccttgagccaggttagaagcattgacttgcgagaagactttttcgttcaatacatttaccagagtaggagcaagacggcgaagcgtcagttcgcggttggccgaaatcacgacttcgtccagattgatggcatcctcttctgcttcgaaattcacctcgatagtcttgtccttttctacgcggactacgcgctcctggctcttatagcccatgccacgcataatcaaagtgatctcacccggacgcaagttacgaagatagtagtgcccggttgcatctgtagatgtaccaaaggtagtgcctttgatagcaatagtgataccgacaaggtgttcacccgtcttgctgtctttgacgtgaccgatgatattggcatcggtcgggtacttgaactcagtgtctgtcgctgcgttcagcccactgaacgcaatgagcgccagcaggataaaaaagattttttttccgatcatgtttttattgtataaggtgggaataggttccctaaagcatttcttccgattccgcccaaaaaagtaaagaggatatcgaatagaatctgctcatcatataaaagagaggcgacacccatattgttcgcctctctttgtattcttagtttatttttggactctctcttactttttcccgggcttgatcccgataagttccatctcgaacgtcagggtagagaacggttcgatggtatagttgccggtctccccataagccagctcctgtgggattaccacgcgaactttctgaccgaccttcatgagttggagcatctccgtccagcctttaatcacaccggtaacggcaaattcgattccttcttcgtttttgtcgaactctttaccatcgaccagagtacccacatacttgacacgtacagtatcggccaaagagggagtagctcccgtaccttcctgaagagtcttgtatgccagaccacttgtcgtaacagttacaccatcttcttttttaaaggtatcgatgtattcattacccttttcgatgttctggccaaactgcttcatattgttttctcgctgctttttggcttggattcgttgcatgaaagcctgtgcatctgcaggcttcatggcgatagatacggtgtcttaagaagagccggggaccgagg

SEQ ID NO: 463 - DNA (genomic), 561 bp, PORYPHYROMONAS GINGIVALIS; double-stranded, circular
  misc_feature 1...561
  hypothetical: NO
  anti-sense: UNKNOWN
ggacgtattccgctcaatgaaacggatcgctcgcccaaagcgagtgtagaattttccatgcgtgggactcctacggatatagagaagctgcagcgcaactttatggaaatggcttctcagctcaatatggatatttcgttccagcgggagagcatgttccgtcgcatgcgtcgtctcatttgcttcgatatggactctaccctgattcagacagaggtcatagacgaactggctatcagagccggagtaggcgatcgggtaaaagccattactgaaagtgccatgagaggcgaaatcgactttaccgaaagcttccgccagcgagtggctctgctgaaaggacttgatgtatctgtgatgcaggagattgccgaaagtcttcctattaccgaaggtgtggagcggctaatgaagatcctcaagatggtaggcttcaagatcgctatcctctcggggggattcatgtacttcggcaactatctagccaagaagttcggaatcgactatgtctatgccaatgaattggaagtaaaagacggtaagctcacgggccgatatgtc

SEQ ID NO: 464 - DNA (genomic), 704 bp, PORYPHYROMONAS GINGIVALIS; double-stranded, circular
  misc_feature 1...704
  hypothetical: NO
  anti-sense: UNKNOWN
gggcttcctcttttcgtgaaacccaatgtgggaggttccagcatcgcgactaccaaggtggtggaagctgcacagctccttccggcaatagaacaagccttctcggaaggcgaagaggtaatgatagagcgtctgatatgtggtaccgaggttacctgcggggcattcctcagaaaaaaagaagtggtcgcattgcctgttacagaagttgtcgcacataatgagtttttcgacttcgatgccaaatacaacggagctgtagaggaaatcacaccggcgagaatcagcgatgaagccactcgattgatacagaccatgactgcgcgcatatacgagcttctcaacgctcggggcatcatacgtgtggactatattcatcgaagcggatggtattcccacgctgctggaagtgaacacgacaccgggcatgacccctacgagctttatcccccagcaggttcgagcagccggaatggatatgaaagaggtgctttgcactatcattcgggatggactgaatgagacccaatagcggacaacttcacgataaatgactatgagtacaatactatttgacgacatcagaccatactgcgatcaggaagcaccggccgtaatcgaacgtctgctgagttcggccgaatatcggtatgtgttcggcaaaatgatgccggacgtaaagccacaggagttcgaacaaatga

SEQ ID NO: 465 - DNA (genomic), 510 bp, PORYPHYROMONAS GINGIVALIS; double-stranded, circular
  misc_feature 1...510
  hypothetical: NO
  anti-sense: UNKNOWN
cggcatcgttctgtagcgacaggtacgaccatacggctacggggatagttttggctttgcaccaaattctcttttaatcattcgactgacctctcgataaatgaggagaagccatttcatgaaccgcacatatccgaaccggctttcagagagtaagatatacggtgaagtatatggcttcttgctcaatgaaatccaaatttgttacaaatatactgacagacagtgattctaccaaagcatccattccatatatttccggctgtgagtgcaacacaataaacaaaggccggttagaggtcgaagccggatattggagcggattttagtagttttgcgctccgttagaaatactgaatataaggatgtttcaagatccaagaaacgatcgtcaagccctgacctcttcgacaagtattttgtctgcgattatgctacgtgtcaggggatttgctgcgtggaaggagaaagcggtgctcctctcgaagcgggtgaaagccgattttgctg

SEQ ID NO: 466 - DNA (genomic), 550 bp, PORYPHYROMONAS GINGIVALIS; double-stranded, circular
  misc_feature 1...550
  hypothetical: NO
  anti-sense: UNKNOWN
ggcaatgacaatttgcaaacgataacagtgcgtcgcaatatggccaaattcagcttggccatgaataccgccaagctgacagaggtggagtactctctttataacacctttgacaaaggcaccttggctccattcgacccctccgaaacgaatccagacttagcattcaaaaaagattttgtgaccgagccggccggagctgattttgataatcagaaagggttcaaacctgtcggtcctgagaatttcttttatggtttcgagcgtaaaaattcagttattgctgcgggagaacaaatctcttgcctgatcataaaaggcaaatatcaaggtagtaatgccttttcttactacaagatagactttgtccatcaggacgacaagaccaagcgttacgacatcatacgcaatcacttctataaggtgacgatcaatgatgtatttaaagccggatttcccacaatcgaggcggctctttcaggtgctgctgcgaacaacatagctctctccgaggagctgcaaatgtaccccgtctttctctgacggaaag

SEQ ID NO: 467 - DNA (genomic), 540 bp, PORYPHYROMONAS GINGIVALIS; double-stranded, circular
  misc_feature 1...540
  hypothetical: NO
  anti-sense: UNKNOWN
gggttcaaagagatattggtaccggccgataatttccggcaggaggatgccggccgcttcggtattcggctcgtgccggtcagaaaggtggaggaagccttccgccatctgttctcgaaaggaagagaatagaaagaacggagaaaacacctatcaggagagagctacaatttccaaaaacatacaagtaataatgaaagagaacaaactattccgtatcgggatacttgccatcgttgccctcttgctcacaggatgcaaggggagccgatacgcattttatcaccgatgcagacttccgcaaacaggtgcaagaagatctgagagtaaaacgcgaagctctatccgaaggcaatctcttcgaagtgctggagcgcgattcgctccgtaccgaagagcgcgaagcactggagttcctgtatgcctacatgacttctgccggacatcgtggactactcgggcgacttctacttgcagaatgtacgcgagagcttccgcgcaagaagaagaatgtcgtggggtaaggaagtgcccgactgg

SEQ ID NO: 468 - DNA (genomic), 3545 bp, PORYPHYROMONAS GINGIVALIS; double-stranded, circular
  misc_feature 1...3545
  hypothetical: NO
  anti-sense: UNKNOWN
tccgaacttatggctctgaggtaactccacttgtcgcccacagtgcggaagagtcttctctttaccatcgaaaacgatggtcagaggttcggccagaggcttcttctcatccaccatcagggtaatgagtacatagtccttttccagcatgctctttactgtaggatcgatccaaacggcattctccatctttctacagttcacgcagccgtgacctgagaagtcgaggaggacaggtttgttctcctgacgagcaaaagccataccggcctcataatccgtaaagtgagcatgaacttcgccactatagagattgaaatcctgcgtgtggagcggcggagcaaaagcacttacagccttgagcggagccccccacaaaccggggatcatatatacagcaaaagccaaagagacagtagccatcataaagcgcggcacagagagatgtggccattcgctatcatggctgaaacggatccatcccaagagatagcaaccgagcagagcgaaaatgacaatccagagagcgaggaaagtctcacgatcgaggatatgccagccatatgccaagtctgccacggagaggaacttgagagcaagagccaattcgaggaagccgagtaccaccttcaccatattcaaccatcctccgctcttaggcataccctgcaaccagctggggaagaccgcaaaaagagtaaagggcaaagccaatgaagtggcaaagccaagcatgcccatggccggagccagtttggagccggctgtagcagcctgtaccaagagcgtaccgataataggaccggtacaagagaaggacaccaaagccagcgtaaaggccataaagaaaatactgagcaaaccggtcgtagagtccgccttgctgtccagcttgttagtccaagatgacggcaacaccagctcgaatgctccgaagaaagagatagcgaagactaccaacagcaggaagaatatgatgttgaagaccgcattcgtggccaaactgttcagagaattgacaccgaaaatacccgtaatgagcaagccgagcactacgtagataacgatgatggaagctccgtaggtaaaggcatctctcacggctttcttcttgtccttattacgcttaaggaagaagctcaccgtcatcgggatcataggccatacgcaaggagtaagcaatgcaacaaaaccgtagaggaaaccatagaggaaaatcttccacggagcactctctgcctgcttgagcgtatcatcaccgtatgcacgcaactcgctaacaaccggtgtccacaagtcagccttggacgaaagagcttcggcagcatcggtctgcgatgtagtatccgctgcggtctcggcagcaaccgcttcagcagcttcagcttcggtatcaggagctgcagccttgctcttgatcatcgaagcatcgaaagagaagtcgctcgtttcgggtggcagacagttttcatcattacaagccatgaagcgaacaccacctttgatagagaatttggcagggtccgtcacctgaattttctgacggaaagagacagtcttctcgtaccatctcagatccatttcgaactgcttgtcgtatcggttgacaggagctttgtcaggaatagccttaccgacaagtttggctcccgtcattttatcgaacaggaattctgtggatgtagggccatcctcgggcagattttggtcataaaggtgccatccgggtttgatcgtggccgtaaacaccaatgttttctcaggcgtgtcgctatcctgaagagaggttttccaaacgactacatccttgataatctgagcagatgccccgatgggcaacatagagagaaacagtagggctaaagctaccgtccatttgctgtttctgtggttcttgtttgtcattattatatgttggattattaaaattagtcagctacctatttggaacgtttttttgtctttgatattgtttggtctgctgcagtgccttcttcgagatgtatcaggcggcgaaagagtttgggcaaaggcaacttatattcctgcgtatctcccgtttcaggatgacggaatacgaatcgcgttccctgtagggccagacagtccagatggcggaaagaactaccctgcctccaatcacctgcaatcggaatacccaactgccccatttgccgtcgaagctgattgttccgaccgctcagcaaagtcacttccacgagcgagcataccgctccgcgacgaataaccttgtaacgagccgttcccaccgaatgaacggaaggagtctcagccacgatacgagactgcttgcccttgatcgaggtttgataccgaggaggatccagcgtaccctcggcatcgggcatctctccttcgatcgccatcacgaaacgctgttccaatacgaccttggaccacttgtccaccacaaacccctgtacctctttattcttggcaaagagcaccattccggcagaatctttgtccagtctgttgagcataaagattttcacctccggatcatattgcttgagatgatcgctaacgatgcgcagagcagtcctgtccttattgacgccactggctacagtggagactccggctttcttctcgatcaggacgaaatagtcgtcctgccaaatgatccgcaccaaaggatggcgcagctcttccggtagctgtgtccgatgcacgattaccctgtcgccggctttcagctctgcatcgtgtcgagtagtcggcacaccgttgatggaaacttgccgtctcgtcaatatctgcttaacggacgtgcggctattatccttcagcatacgaacgagaaaaggcaagagggtatcctcttctctgacttcgaaaaccttgtccggctgacgtctcaggcggggtgaccgactttttggaggttgcatatttcgtttgtagagaatcttatttcttgttttttccttgctctcccgatcctttcctgaagagcagaagcaaggaagcataaatcatgtagatcacaccaatggcaaaaaacaagagccaaagggaatctgctcgtacaaagaccaatatagccgagactacgaaaaaagccccggaaaggacattcatccggtagagcctgcgcgtacgagtatccaaatccgcaacaggagtcagggcataggaaagcagatagagtaccgcccccaatgcgtagaggtaatctccgggcaacaaagcgtaccaatctgggatgctgctccgaagatcaaaaggagactgccgacacggtagcttatctcacgaatctgctgtgggttcatccctgctgcccctattttcgttattgtttgtcttggacgctatccttgatcagaaaaatgatctcttcgggtcgcttcatcagatacaactctctggccgtatgctctattcccctgtttgttcgcccggatttcttccagtcgcacactatcctgatgataacgttcctttacctcccgtagttctttcttcaaattgttgatacggcttttgtagcgaatctgcttgctgatattggcatcgcc

SEQ ID NO: 469 - DNA (genomic), 664 bp, PORYPHYROMONAS GINGIVALIS; double-stranded, circular
  misc_feature 1...664
  hypothetical: NO
  anti-sense: UNKNOWN
tagaggatcccctgtagatttctcgtcattgtatagctgtctgaaagggaataccgctgtcatgttctgtgaagtggctaattctccggccaaagtaatcaagcagtttacaaaggataccaaaggagaaggaaagccttggctaaaagctgcatacgtgcaggaaagcttctacattgggagggaaaatctcgatgctttggtttcgatcaagagcaaaaacgaactcatcgcagatgttgtggcattgctgcagtctccggccaagaacgttattgcatctttgcagtcagcaggtcaaacgatccatggtgtgttgaagaccttggaagaaaaataattcaacagtataattgaaaacttttaatactcaaaaataaaatggcagacattaaagctattgctgaacaactggttaacttgacagtaaaagaagttagcgaactcgctactatcctgaaagaagaatatggcattgagccggcagctgctgctgttgctgtagccgctgctcctggtgctgccggtgctgcagctgaagaggagaaaacttctttcgacgtagttcttaagagtgctggagctgcaaaattgcaggttgtgaaagctgtaaagaacaatgcggtcttggcctgaaagaagcaaaggatctcgtggacgcaga

SEQ ID NO: 470 - DNA (genomic), 769 bp, PORYPHYROMONAS GINGIVALIS; double-stranded, circular
  misc_feature 1...769
  hypothetical: NO
  anti-sense: UNKNOWN
agcggggccaaaccttttctccacccttgccaaaaaccagcttccctttttctaagttttctattatagcagaaataaatgcattattttccagctccatagattattccgggtataatggttgttgcttttattgttttcatataagagtcgaccactctatctgcggataatttgctcttagcgtaatctgtaaattggagcttacaccaaccttttatcctgtaggctgcaatggaggaacaatttatgagtctgcactcaggattatattgattgattgctttgcaaagattttctgttccaagaacatttgattgataatattctttctttgttgttcgtgaaacttgtgccgccaagtgaacaattacatcttgtccttttacaaaatcttcgagagattccaagttcgataaatctcctttgataactttgactttatcttctattgtttctatattgctactttcccttgtcaaacaggttattggtgtgtttgtttttgacaataattcaacgagtctgtttccaagaaaacctgttcccccggttatgccaattcttatcatttttatatcattcataaaatatttctttattattatcgntctctccaaagagtgtagtaggcgtacngatatccatgtcgcangaaagcaagtatgggtttttcggcctgattgggaatcggagacttaactaaaagaactttttcttttttgtgttttcgtctgaaattcgagaaaggctctaaagactacctatg

SEQ ID NO: 471 - DNA (genomic), 873 bp, PORYPHYROMONAS GINGIVALIS; double-stranded, circular
  misc_feature 1...873
  hypothetical: NO
  anti-sense: UNKNOWN
tcagtccatgaagaataggcagcggatccactccgacaaacgaacggcaatcatcttgtaagatgggaccatccacgtagtcgttcgggttcggccgatcagtaacgatcagctttttctgctcctcggcacaagcctccatcacatagtgcagcgtactgatataagtaaagaagcgagtcccgacatcctgcatatcgaatagcagcacatcgacgtcggccaacattcgaggagtaggtttcttgtttttgccgtagagcgaaacgatagggattcccgtcctgacatcccgttcatccttgaccgttgccccggcatcggcatctccacggaagccgtgttcaggccctaagatcttgacgacattgactccctgccgaagcagattgtcaagaagatgttcccgctccgtccccaccacgctcgtagcattagccaccagtgccacacgcttgtctctgagaagaggcaggagcagctctgtcctctctgcaccgacaactacccgtacctcctctcttggggttgcgaccgaaatctcctgctccgaatgagcagtctgactcccgacttcctcactcctcgacgaatgcgctacccctgcaacttggcaaccggtataggccgaaaacgacattagcccgctgatgcaggctaatgcgatagaatatttccggaaaaagcgagggatcatttgccttcgtttactcgtcgatgatcttccaagaaagccttcaatccactatccgtaagagggtgcttgagcagaccctttgatggcgttgagcgggcaagtagccacatcggcaccggctttcgaggcactgaataatgtgctgcgtatggcgggatgctggcagcaagtacctt

SEQ ID NO: 472 - DNA (genomic), 702 bp, PORYPHYROMONAS GINGIVALIS; double-stranded, circular
  misc_feature 1...702
  hypothetical: NO
  anti-sense: UNKNOWN
gaagccaacaactgttatgcaagcaattcctgaatacgatgataccggtagactatccaaaagtcaaagtattgcctgcgagtaaactcccaaacgaaacctccggtttgcgtcataactcagacaagcaaagggattaacattaaggtaaggactgttgatgcagtcgatgatgaaaacctaaacggacgaataatagagaatttttaccccaatgatactcttggccccgaatcggaagagaaactaaaaaggttgggggttttactctccaaagcctccgaagatttcgatcttcgccaaaccaatgaaatatccatcgacttaactgttttcaaagatttggctgtttcaatcaccgaaaagcattgtaatttatacggtgagacaatctcatacggtgaaaaaatgacactgaaaaagggagacttaatgaccaagccatttttcaaaggcctctataaggtaaaagaataagagcatggcaaagcgaataatcacgaggataggagacgtttttgaagtccaattagataattgcaagaagtactttcagtacatcgcaaatgacatgacacagctcaacagtagcgtaatacgtacttttgtggaagaataccccttggactgttctccgatcttagaaaatattacccgcgggtaagggtgattttatgcacatacagtcctccgatggggtat

SEQ ID NO: 473 - DNA (genomic), 8439 bp, PORYPHYROMONAS GINGIVALIS; double-stranded, circular
  misc_feature 1...8439
  hypothetical: NO
  anti-sense: UNKNOWN
gccgtttgctgttttcgtatttttgtaaagtggcagccgttttattgattcccacctgggcccggacatcctcgttatgtttatcgaaaagttccactatactgtttaatgtatccgtctgtccgcagtattccgatttgatcctctccggcgtcaaatcatctactgttacttccaaacgtttgtaaatggtcagaatatcagccctgatttcttcgatctttcgattgacttcaagtgcttctgcactatgtcctttgactttttctttttctgaatcccataattgggcattgacagacaggcctgtagaccccagcgacaaacgctccttattcagataaatccgaatgaggatgggcgtcttgccttctttgttgatgtaattgctgcgcaagtaaaaaactgaacgaaattgactcttcattttgctccaaaattagtgtaaccatacggctacaaagttcgacatatgattttgaaacagagcaatttgtcaatcgtctaaacatcgtcttaacgtcgtctgtggttacaatttttcagcccctttgttttttgtaaccaaaatggaaccaccggaggcatatttacggaatatacgcctattccgaacctcatccgacgtgtggggtggcgacaaagaaaaagcgccttaattcgttggaattaagacgcttttggattcgtttctaaaattgcttcagatgacctatagcctatctttcagctatttagcggtatggacgggactcgaacccgcgaccccctgcgtgacaggcaggtattctaaccagctgaactaccacaccgttgcgaatgaatttacctctttcagcgctgcaaagataagttttttcctcaatatgcaatagtcatcaaaaaatctgcacattccactcaccagtgcaacattgagtagctaagttagttctaaaacttggcatggcgttagatgccctagcccttttcgaggtcttcgattaagtttgtcttgtattcttccacaatgtggagatgtaacttatgttttttaggtattaggatgtcaataacagtttggcaagggatagatcgagaggagtagtcaatttgatattttcgatattaccgacaatcaatgccaccggtcggccaaaatggtgttcatataccgaacaatcatcggtaaaatactcttcatagggttgccgataggcctctcgaagccattcgctccgaaaggtctgtggagtttgtaccgtgacgtaccgactcctgtccactgcataattgccatcagtggcataatagcgaagcgattcggtcatagggcgacaaggagcgacagcccccttcaactctgcaagatcgaaacaggcatcgatagtttcagcactgaccaaaggacgtaccccgtcatgaacagcaaccaaaacaccatcagggacaacctgcaatccattccgaacagaggcgaaacgtgtatttccacctgcaaccactcgatgagagaccgaaaagtcatacttccggcacaattcctgccaataagcatgatgatctgtgggcaataccaatacaatagcatcgacatgaggggcaaagcgattcagcgtatgcatcagcaccggtagaccggccaaaagcaaaaactgttttggccgatcggcccccatacgtagcccatgaccaccggctacgatcagagcatagcgtttttgctccatgagagtttggccatgagttcttcgatctgcttgtcggctactgtcagtttctcacgacagaaaccaatcagagcaatagcctcttcggccagcttggtcagctcgtccacatccgggctttcatgttcgatgacacgaacgatttcttcgaggcgtctcatggcctccgtataagtcttattctcactcataataatggcaaaaataaggatttgcagaagaaaccgtaaacgaatcctccggatcaaactctaaaaacagatgagaaatactagaagtagccgaatgagtaaaaaaactcgcccctaagggaggaggtttccgtttttgtgaactcaccccaataaatccaaagatcaattccgtattgcagaaccatctaacctgtctttcggcccctatatttcgatctcaccacaagaaaaaactaaaaaaatatatcatcacggcattaacataaaagcccactatcatgtttttaacaaaaaactattattattgtagtagacaaatacaagacactattatgattaatatacatacgcgactaactatcctgacatttcttggatgtgtctttatgctctcagccaaagagattaatgtagattcccttttccaaatagcggccgaccggactctttctgccacggaaaagaaaaaaaggtatgaggagatgggcaaacagctcgaactgcatcaacaagtcggtagtgcagccgatgcatattccttagccatcaagttctgccgtgatggtggctcgaccgaagagcttccatttctgcttttaaagtatgcaaccatggcgactcatgcaggtcgttatagcaatgcaataatggctctagaagaaataatgaggctgcttaaagacaaaaacgacaacattatattagcccgcacttatatgcagataggcatcgtatttttctttcaggaaaagtgggatgaccgcattggtattctatgaacgtgcgctacaaatcgctcaaaaagaaaaaggaggaaagaggtatctctatagcctacaacaacatggctaacatttatcaaaaaaaaggaaatactcaagaagcctactcctattataacaaagctttggatatacaacgaaccaatggtgatagtgtaagtatgtgcaacagtctcatgaatatcggcacaattatgatcaatgagaaaaatcctgaggatagctataagcctttgaaagaagctcttacaatagcatccaaaataaatgatatcgagatccaggccctatcttatgcacatcttgcatattattatgcatggagaagcgaatacggcaaagcaaatgaagtgctcacaatcgcagaaaatttggcatgccatgccgggtataatcaaaccagattggcaatattggatatagccagttccatatatgccgaatacggcttgtactctttggcttatgaatgccaaaaaagatccaaacttctggcagactctattgccgccaaacagatgcaagaaaaaattacggagtttgacattcggttcaaaagcaaagagaaagaggccgaaatagcactgaaaaaccaggaattacatttagctcgcaaattacatattgcccttatcataatatccacactgttggtggcaaccatcattacccttatcatccatgcagcaaggagatacagacaaaataagagactgcgagaaatgaatgacaccagaaacagactcctctccattatctcacacgacatcaagggtccggctatagcacagaaaatggccctcgacactatactatcatcttcatctgactgtggctctatgactcggaatatgctttcttcaatacgcaatagtgtagcaacagaattgactcttttacagaatttactcgattggtctaatatccaaatcgggaatttagctcccaaatttgtggttttcaacattgtggaaaacattggaaaggtgatcaatttatactctatttctgctcggaataaagatattagcttacatttggaagctcctaaacaatgtttggttcatgctgaccaacaaatgatcaataccgtaatacgcaatttactcagtaatgcaatcaaattctctaaagcaggaagcgtaatacacatccgtgtggaagaaaaagagaaagccatggggatcaaagtgtctgtatcagacaaaggtattggcatgagcaaaaaacaaataaccgatatcctcgaatcggataaaaataagaaggctacagccgggaccgatggggaaataggtagcggattaggtttaattatctgcaaaggtctgctcaaaaaaaaacaaaagcaagttatgcattgacagcaaggaaggtaaaggctccgtattctcttttgtccttgcctcagcgtaaagattacacaatatgattagtatcgtactcgtggatgaccacgaactctatcgggtaggtttgcgtgctgccattagtcaaatgcaaggtttggcagaaatcgtaggtgaatgtagttcttgtgaagaactggaaacgtttctgaaagaacaaaaagaaccgggactaatcatactggatatttggcttcccgatgggaatggagtgaatattgctcgtaagctaaagaagctatatccggctgttaagattatcatactgtcttccgaagtatcagagaaaacagtcaatgaactattggcgattgatgtggaaggatacatatgcaaaacagctcagatcaatgatataggaaatgccatccgcacagtaaccacgggtagccatttctatggcaaaagtgtttcgaagatgatactggatatttgcgtatcacgttccgcagaccaatcgcataagaaaagcaaaaaacagcaacagcagcagaacgactcttccgagctgacccaacgagagaaagaagtagtacaatatctgtgcgatggctattctgccaaagaaacagccgaaaaaatgcaccttagttaccgaacggtagaaacacaccgtagtaatattctgcacaaactgggattcaccaatgcagccgaactgatacggtatgccgtaaagagcggattagtggattggcaatagctctcttttcggctacctgacggctcaagagaagacaagtaaatcggatattggaggcaagaagagaagaaacgttttcgatcaaccattacatatcgtatatttattcggacaggacatttgtatatcacagccaaacgcgtacctttgtgcgaccgaaaagaaataaataattattccataatatggctaaaaaagaaaatcaacaaccggacaaccacgtaggagaagtggtttcacgctcagagcagttcatagaaaagaacatgaccaaaatcggcttggttattctgggcgtttttatcattgtggcaggtatttttgcctacaaacgtttcgtcagcgaacctaaagctcgtgaagctgctgccaaggtataccttgccgaagacaaattcattcaggaattggacagcgcagccttaaatggaaacggtgcaaacgaaatgggattgttgacagtaatcaaaaaatactccggctcggatgcatccaatctggcaaaagcctatgccggcatttgctactacaacctcggagaatatcagaaagccattgatcatctgaagggattctcctccaaggaaaatatggtagcaccatctatcactcgtcttatcggtgactgttatgtacagctcaaaaaatatgaagaggccgtaggctattttgagaaagctgcggccgcagcctctaacgatgccattacaccgggctgtctcatcaaagccggtcgcgtatacgaagagctcaaacaatacgacaaggctctcgctgcttataagcaggtaaaagaaaaatactacacatcgatggaagctaatacggtagaagcagatatcatacgtgtaaaaaccaaaggagcgaaataattgtatcaaaacgataaaaagaaaggcatctatctcatgctgggatggatgccttttttcaggacaaaacttatcagacaattacagaatcatggctacagcttatcataacttatccgactacgactacgagagcgttccctgcggcaaagacttacgtataggaattgccgttgctgaatggaatcacaatatcacagagccactgatgaaaggggctatcgatacccttttggagcatggtgtgtcggctgacaatatcatcgtacagcatgttcccggcactttcgaacttacctatgcaagcgcataccttgccgaacagcatgaagtagatgcagtgatcgctatcggctgtgtagtcagaggcgacaccccccacttcgactatatctgccaaggggtaacacagggaatcacccagttgaacattgacggctttgtaccagtcattttcggagtccttaccacggaaacaatgcttcaggccgaagagcgtgccgggggcaagcatggcaacaaaggcacggaagcagccgttacagctcttaaaatggcaggattggaaagaatataaattccggcttttttcattcagattgcctgatcctaatactacatcatcaggaaacacttttgtagaatgcagcaaattctacaatgccccatagggcgaccacagcaaaaaactctcataattcggaatatcaccttcaatgaaaaaaagttttcttttagccatagtaatgctctttggcattgccatgcagggacattctgctccggttacgaaagagcgagctttgagtctggctcggctggctttgcgacaggtatccttgcgaatgggacaaacagcagtatctgacaagatttccatcgattacgtttatcggcaaggagatgctgagaggggtatcacatcacaagaggaaggctctcctgcatatttttatgtagctaatcgtggaaataatgagggctatgctcttgtagcagcagatgacagaataccgacaattttagcctattcacccattggccgtttcgacatggacagtatgccggacaatcttcgcatgtggctacaaatttacgatcaggaaataggcctgatactttccggaaaagctcagctcaatgaagagatattacgtaccgagggcgtaccggctgaagtacatgctctgatggataacggtcattttgccaacgatcccatgcgatggaatcaaggttacccatggaacaataaggaaccactgcttcctaatggcaatcatgcctataccggctgtgttgctactgctgcagcacaaatcatgcgctaccatagctggccgcttcaaggtgaaggctctttcgattatcatgcaggttcattagttggcaactggtccggcacatttggtgaaatgtacgactggatcaatatgcccggaaatcccgaccttgataatctgactcaatctcaagtggatgcctacgccacactgatgcgtgatgtgagtgcatctgtttcgatgagtttttatgaaaatggaagtggtacgtacagcgtttatgtagtaggagccttgcgaaacaactttcgctacaagcgttcactgcagctacatgtacgcgccttatatacctcacaggagtggcacgatatgatccgcggggaacttgcctccggaaggccggtctattatgcagggaataaccagagcataggacatgctttcgtttgcgatggttatgcttcggatggtactttccatttcaactggggttggggaggtgtttccaacggcttctacaaactaacactcctctcgccgacttcgttgggtatcggaggtgagggaataggttttaccatttatcaagagatcatcaccggtatcgaaccggctaagactcccgctgaagccggtacagatgccttgccgatcttggcactgaaagacatagaagccgagtataaaagtgaatccggattgaacgtagggtattcgatatataatacaggtgaagagcaatcaaatcttgacctcggatacagattgaacaaggctgacggagaagtcatagaggtgaaaacttcatctatcaatatctcttggtacggatacggagagcatcccgagagtttctcattggcacctaatcagttgtcacaaggaatcaacaccatcaccctactttatcgtcgcacaggcaccgaacagtgggagccggtacggcatgcacagggaggatatgtcaatagcattaaagtaaatacgacagacccgaacaatgtcgtagtcacggtagataataacgaaggcaagctcagtatcgtccccaacagctttgtcgcagatctgaattcttatgaacatagtacgattacagtacagttcaatagcgacagccctgatgagatccgtacacccgtagcctttgctctatctacaggagctactgcggacgatgtaatatctttgggctgggtaatggctgaagttccgggcggtagcagcaactatccggtggtttggtctaaagacgttctcactctctcggaaggcgactatacattgtggtatagattttccatcaacaaccaaaaggatgaatggaaaaagatcggaagcgtgtcagtaaaaacaccgacagagtatacgcaccccttattcgaagtgggccataatcaaacttctacctatacgctggatatggcacacaacagagtattgcccgactttacactcaaaaatctcggattgcctttcaatgg

SEQ ID NO: 474 - DNA (genomic), 806 bp, PORYPHYROMONAS GINGIVALIS; double-stranded, circular
  misc_feature 1...806
  hypothetical: NO
  anti-sense: UNKNOWN
aaccggctgccatccggcggatcaactcgacaaagtcggatccgattcgcagcatgacgacttccgtttccggatctcccatacggcaattatattctaccacataaggatctcctcctacattcatcagtcccacgaagatgaatccgcgataatcgattccttcggctatcagtcccgatatcgtaggccggataatccgctcttccaccttccgcatgaatgcttcatcggcgaaaggtactggcgaaacgctccccattccgccggtattgagcccggtatctccatctccgattcgcttataatctttggcgactggaagtatgtgatagtctttgccatcggtagcaacaaatacggagcattctatgccatcgagaaactcttcgatcaccacacgacggcttgcagcaccgaatttgccaccgagcatctcagccaactcccgtttggcttcttctgcagtcggagcaataatcacccccttgccggcggccaaaccatcggctttcagtacataaggagcctgcatcgtatctatgaatgccttgcctgcatctgtttggtcagccgtgaatgtctgataagcggcagtaggaatcccgtgtcgtttcataaaagacttgctgaaatccttgcttccttccaaccgtgcacccttggcatcgggccccacaatgaggagatcgtgcagtgtgtcgtgatttcggaagtagtccactatgccacgtacaaggggttcttcaggccccactaccagcaggtcgatagaactcgcgctgtaccacttcggcaaacggcag

SEQ ID NO: 475 - DNA (genomic), 2247 bp, PORYPHYROMONAS GINGIVALIS; double-stranded, circular
  misc_feature 1...2247
  hypothetical: NO
  anti-sense: UNKNOWN
ataaacaaagttttggaacatatatccaaagatttnatttatatatccgaaggcttcggacagagattttccggccggaaaatttatttttgtcggttgtcgggaaaaattttcccggcccggaagaaaacaatcgaccggcgatgagtaaaccgatatagctgtacagaagaaatggccaagtttgtgatgagagaaatgcccgatatgcaaggcacgggcaagcggacgatgtatccgaaaatgatcagccgaggcacgatggggctggacgagatagccgatctgatttcctcccaatcgacattctccccgggtgaagtcaaagggttggttacggccttggctcggacgatagcccacggcgtggcttcgggatatacggtgaagatagaggagatcggctctttctccgcttcgctcaccttgcacaaaggcgtagaacccgaggaggccgaaggcggcacacgccgtaatgccgccagcgtgacgataggaggtgtcaatttccgccccgacaaggcattgattctcgaggctcgtactcgcgttcatctggtgcgaactacggtacgccgtccccgtcggcccaatttgactcgcgaagagcggctggccttggccttgcgccatctcgatggccatagtctgctcaaggtggccgattattgcagacttacggggctgggacgtaccgctgccgcggaagaattgcgcgctttcgatcgcgagggtctgatcgactccacggggagcggcacgcataaggtatatattataaggaacaaagccgggatctgacaaggcgggaagaccaccgttacgggctttttgcgttcttaagaattgcgctatttttgtgtgtgcaaagaaagatgtgtcggataggcgaaccttgctcttgcccagttgagagtccgagtcgttgccgggagacagagagagaaaggtattcgccgaatttttttgtgcagtctaacctcataacatagatttaatgagtcttatctttaccgccattgtcgtatttcttttcatccttgctatattcgacttgattgtgggtgtcagcaacgatgcggtcaacttcctcaattctgccatcggagccaaggctgctccattcaagatcatcgtcggtgtggcagcgttgggggttttttgtggcgcagccatgaacaacggcatgatggagatcgcccgacacgggattttcaggccggaacattacactttcagcgaattgatggtcgtatttctgtcggtggtgatcaccgatgtcgtcctgatggatatgttcaattcgctcggcatgcctacctctacgaccgtctcgctcattttcgagctgttaggcggttctttttttatggccatgaccaaggtgggcggtacggtcggctttcaggatcttctcaatacggagaaagctctttccgtcatattgggtatcttcctttcggtgggaattgctttcttcttcgggatggtcgttcagtatctgagccgtttgctctttacctttaattacaggcggaatctccgatggctggccggccttttcggcggagttgcggttacatccatcatttatttcatgctcatcaaagggctgaagggcgtgtcctttatgaccgaagaatccacggcttggatagctgccaatacgggcaggctggtattgtactgtctggtcgtttccattatcctgatgcaggtgctgtattggctacgggtcaatgtcttcaaggtgatcgtcctcttgggtaccttcgctttggcgatggcttttgccggcaacgacttggtgaactttatcggtgtgccgctggccggttattcctcttatttggacttcaatgccaacggaaacgggcagtacgatacttatctgatgggagccttgaacgaaccggcttccactcccgtatatttcctcgtggctgccggtatcgtaatggtatatgcgctgattacatcgaagaaggctcacaacgtgatcaagacttcggtggatctggcgcgtcaggaggaaggtgaggagatgttcggctcctcgggcttggcccggagtatcgtgcgtttcagcaccacgacggccaatgccgtgtcccgtataattcctcgtcccgtaggccggtggatagacagtcgcttcaatcaggacgaactgatcatggccaagggcgcggctttcgatttggtgcgcgcttcggtcaatcttgttcttgccggactgctcatcgc

SEQ ID NO: 476 - DNA (genomic), 711 bp, PORYPHYROMONAS GINGIVALIS; double-stranded, circular
  misc_feature 1...711
  hypothetical: NO
  anti-sense: UNKNOWN
aattgctctcacgttccttttgcatcgactctattcgtgtttggttcagttcgcgaaaacgctgtagcaagtctttcagacgctcttcgttcaagtccggttcggccatagacgaagttgtactgtcggccgattctcctgtacgagcctgctttttcttatagaaagcacttttgtaggcctctacttcctgtcggcgaggtagctcttctccttggagtaatatggccaagctgtcaagtagctcgagctcggtcatgtccgccaaacgggcgtttacacttgttttactttcttcggctgatttggattcgttttccaaaggagtcggatctgccacttccaggctttgagcctccggcaaccggtctgttgtcgtaggtttcaattcttcggattcaggctgtgccattgaatccgtgagagggttcgtagggttttccatacgttactgctttaatgttcacttccaccgaaaacctcctgtccggagagatacaattcggtacttttccaatacaacggaaggtaattatcagataatgattccgttttcaaaagaccaaattaaagaaaaaatattgacagaccataatttggaaggtgtttgcagggcaaggcattcaaaacaagcattctataaagttttatagtccgttgaatgaagtccgtcggtcatgtattcaagtcactatcgggaaaaatcctctt

SEQ ID NO: 477 - DNA (genomic), 974 bp, PORYPHYROMONAS GINGIVALIS; double-stranded, circular
  misc_feature 1...974
  hypothetical: NO
  anti-sense: UNKNOWN
ggtctttccattcaattcggacttcgtgacgatgaatcggcggctcaccaaatgcgactcggtaggtatccactgcttcctatccatctgtacctctgtcccgatgaagctgctaatcaccgcagtattttgcggattggtaattacgaaaaccctgtcgttttcatttagaaccgtatccgaatgtgccagcgaaatactgttggtacgcgaatccattgtgcgcgaaatcacgtagtcatgacctttgagcagttggcggacttccgctaatgttttggagaaaacggccggattttttacaaccagagagagtgcgatagcctgattatcatcgttatgttccagactgtccatcttctctttctctttggccacactgatcttgaaaatagctcgtacgatcagcatggacgcaataatccccaccactccgagcggataagccacagcataaccgagtgtgatagtcggatcgccggttcccgttagatcatggaatgtctgctcggcagctcccaggcccggtgtgttcgtgacggcaccggacagaattcctaccattgtggacatggatatgcctgtcacgaagtgcagaatcaccgttgtcagtacccccagaaagacgacgcccatagccagtaggttcaaggtaagcccccccttgcgaagagaggagaaaaaacccgggcccacttgcatccccaccgagtaaacgaataggatcagtccgaactctttgaagaaatgatgtacgtcaggatgcagattcatgccgaaatgtcctaagactattccgacaaaaagaacgaaagtaacccccaaagaaattccgaagatctttatctttcccaaccaaatccctaaggcaatcgttacggcgaccaagagaatggagtgccccactcctacaccgaaaagcaagtcattaagccattgcatattcatccaaacagcttatagtagtcaatagt

SEQ ID NO: 478 - DNA (genomic), 1186 bp, PORYPHYROMONAS GINGIVALIS; double-stranded, circular
  misc_feature 1...1186
  hypothetical: NO
  anti-sense: UNKNOWN
gatccccagttttcaagaccaacgttggtaagtatatagcggtatttaccgtccttattcatttcgctgacttgctcgcgtactatccggtacattttctcattggcttccgcctgtttgttggccaaagcttgtgtcatgctgagttccaatctttggccttcttcttgcatcttcaggattttctcctgttccactcgtgcagcatcttcgctggtgaatgcattcgtccgaagacggcgttggaaatcctccgcagctttctgcatggcagtcatcttggtagccaaggttctttggttctgctcagcttcggccgcaagttgtttgttcatgtcccgaaagtattcatattgcgaggccaggctgtccatccttacgaaagctataggcagagtggcggcagcttgttctgccttatgatttgttgtcttggcttttgatgcggatgaacgcggcatcataatgaagaggatgatgatggcaacggccagtacagcctcgatgacataatggatctgtttcatttgtgaatgggatatgttttttgtttcgttattattcgagttctttgattcgatcttcgagattgcggtgatgttgggcttcgaaatgttgtgccgtatggcagccgattcctctgtcttgcattgccttgttgctgcctacatgggtctggggaaacttcccgccacgacagaaaaacacacgtatgcccagcaggacaaaagccagtccgaccaacagaagagaagccaaaaaaattgtagtcatttattgctatatttgcggaatacaaaggtaagattttcttacccacagagaagcacaattaataactcatagtaataacaatgaacattacagatctcaaacccacaaaagtgtggaagtttttccacgaaatcactcaagtgccacgtccttccaagaaagaagagaagatcctggcttaccttgtgaaatttgcagaagatcgcaacctcaaatatcgtacagacgaggtaggcaatctcgtaatagagaaaccggcaacacccggatacgaacacctcgaaacggtcatccttcagagccatatggatatggtatgcgagaagaatgccgataaggttcatgacttcgagaacgaccctatccgtaccatcatcgatggtgaatggttgcatgccgatggtactacact

SEQ ID NO: 479 - DNA (genomic), 7060 bp, PORYPHYROMONAS GINGIVALIS; double-stranded, circular
  misc_feature 1...7060
  hypothetical: NO
  anti-sense: UNKNOWN
ttatggttaaagacggcaacctttccgcagaaaaaaaacgcaaggcctaaattaaccccaactaccagaagagggtgtgtcaaaattcagtttcaagcagggggccgggatcatcgtttgtatagaaaaaccgctatcaaatcaatagtgtcctaaatgtttgcttagaggggggagtttttagtatgagagctgagtcgctccaatacaagacttttgggatttgagggggatccccctgcctacggaaagagctgattttgttcttccggcggaggcgaaaagggttcattgatccattggccttttcttacgtcgagctgacgtgaggttatcaatcgcatagaaactcgaaccgaaaatcgcccaaatctgaaaccaaaatcccccaaaaatggtgcgagaatcttttcgttctcaggcgagattttttcaactcccgaaccaaaataaaaattttctcagaccacgtttttcagaactgaaatacaccggatttttcagtacacgtcaatcattcggaagcgaaaaaggcagtctgaatgaaagaatgcgccagattgtcagttccggaccctgtggcatcggatttgtcgttcctttcgacggaatagaaacaaacaaaacattaacagataataatacactatgagtaagaaaggaacaatcggggtaacgagcgacaatatattccccgtcatcaaaaaattcctgtacagcgaccatgagatattcctgcgtgagatcgtctccaatgccgtggatgctacgcagaagctgaaaacgcttacatccgtcggcgaattcaaaggcgagacgggtgacctccgcgtaacggtcagcgtggatgaagtggcacgcacgatcacggtcagcgaccgcggcgtagggatgaccgaagaggaggtggagaagtacatcaatcagattgctttctccagtgcggaagagtttcttgaaaagtacaaagacgacaaggccgccattatcggccacttcggactcggattttactcggctttcatggtgtccgagcgagtggacgtgatcacgcgctctttccgagaagatgctacggcggtgaaatggagctgcgacggatcgcccgaatacacgctcgaacctgcggacaaggctgaccgtggcaccgacatcgtgatgcacatcgatgaggagaatagcgagttcctcaaaaaagaaaagatagaggggctcctcggcaaatactgtaagttccttaccgtgccgatcattttcggcaagaagcaggaatggaaagacggcaagatgcaagatacggacgaggacaatcagatcaacgacacacatcctgcctggaccaaaaagcctgccgacctcaaggacgaagactataaggaattttaccgttcgctctatcccatgtccgaagagcctctcttctggatccacctcaatgtggactatccgttcaatctgacaggtatcctctatttcccgaagatcaaaaacaacttggatctgcagcgcaacaagattcagctctactgcaatcaggtttacgtcaccgatgaagtacagggtatcgtgccggacttcctcaccctcctgcacggggtcatcgattcgccggatattcccctcaacgtatcgcgctcctatctgcagagcgatgccaatgtgaagaagatctcgtctcatatcaccaagaaggtggcagaccgtctggaagaaattttcaaaaacgaccgccccacattcgaggagaaatgggatagtctgaagctcttcgtcgaatacggtatgctgacggatgagaagttctatgagcgtgcagccaaattcttccttttcaccgatatggacggacacaagtacacgttcgacgaataccgaacgctcgtcgaaggtgtacagacggataaggacggacaggtagtgtatctctatgctacggacaagcatggacagtacagccacgtgaaacgtgcatccgacaaaggctacagcgtgatgctgttggatggtcagttggatccgcatatcgtgagcctgctggagcaaaagttggagaagacacactttgtccgtgtcgatagcgatacgatcaacaatctgatccgcaaggaggaaagagccgaagtgaaactgtccgatacggagcgcgccactctcgtgaagctgttcgaagcacgcctgccacgggacgagaagaagcacttcaatgtagctttcgaatcgctcggagccgaaggtgaagccatccttatcacacaagccgaattcatgcgccgtatgcgcgatatggcacagctgcagccgggaatgagcttctacggcgaactccccgattcgtacaatctggtacttaataccgatcatccgctcatcgacagggtactctccggtgagaaagaatcggtagagccttcgctcacagagcttagagcgaaaatcgccgagctgaaagcggaagaggccaagctgctcgatgaggaaaaagggaagaaaccggaggaaatccctgttgccacgaaggaagccaaggagaacaacgccgtcgaacaggccaaaaccgaaggcagtatcaacgatcaactgaccaaatatgctcaggacaacgagctgataggtcagctcatcgacttggctctgctcggaagcggattgctgacgggagaggctttggccgaattcattcgtcgcagccagcgtcttctctgagaagtgaatagtgagttgtgctgaaaacccaattcttccactctccttgccaatagacatggcaaggagagtgagggtataatacaaggaacccccgaaagccacggctttcggggggttgcttttatcagagcttccgccggtctcttttcctcgtcggaatgggtggccgggaaaaatgcttacaatccgaagatcagaatgaaaagatagacggccgggaatacgaagagagcactgtccagccggtccagtatacctccatgtccgggaatgatatggccggaatccttcactcctgcattgcgtttgagattggactcatacagatcgccccaagtggccatggccgttaccagtagagcaaagaagaccagctccatcggatgcttggccgaaccggaatagtggcctgccagcaatgcacctgccacagtgaacagcagccctccgataaagccctcccatgttttcttgggtgatatgaccttgaagagtgtatgcttgccaaagagggaacctgcaataaaagctcctgtatcattcagccatatcagcacaaaaacgaagaggaagtagtgaggcgtgaagtctgccacttctcctactgccaactccctgccgatactttcgggcacgagcagaagactacccaaaccaagcgttgccgctatatacagatgccccatgaaagtgcggctattgtccgatccggccttatggcgatccgaatatagactgcgcaccatagtgtagaggacatagaagatatacgggataaatatcgtgacatccattcggtcactgccgtataggaagatggccgcaaagaggaaggcaccgaaaagtccgtccatgaatgcccgaaggggacgtgtgcgattcagattgaccagcgaggcgaattcccgcagtcccaacacgatgaaaacggcaaaaaccgctaagaacaaagccggttcccttagtacgacgggaaggatgatcagggccatatagaccagaccactgaggctgcgaatcaaaactgctttcataacgtaagctcgatagtctctttatattttattcgggatgttcttccgtcttctcttctccctcaacgggaatgggtgcttcggcatccgctgttgtctcttctgtggcggtagccggtgcattcagcccaagcaattcttctgtacgcgaagcccaggggcgtttgccgaatatacgctctacgtcatcagccagaatcacttcgcgcttgagcaacagatctgccagttcgtggtgcccggcttcatgctcgcgcagaatgcttttggcgcgctcgtattgttcggatattattctgtttacttcggcatcgataacctcggcggtagtatcactgtacggctttgtcagattccagccgtcgttttgcatttcgtagtagttgatgttgggcagcttgtcgctcatgccataataggtaaccatggcgtaagccaacttcgtaacgcgctccaagtcattggctgcaccggtcgatacacgtccgaggaagagatcttcggcggcacgtccacccaaaagggcgcaaagctgatcctgcagagcctccgttgtcgtgatctgacgctcttccggcagataccaggcggcaccgagtgccttgcctcgcggtacgatagtgactttgacgagaggattggcatagcgtagcatccaactgatagtagcgtgtccggcttcgtggatggcgatgctgcgacgctcctcctctgtggtgattttgttctttttctccaatccgcctacgatccgatccacggcattcatgaagtcttccttgtctacgaagtttttattgcttcgcgcggcgatcaacgccgcttcgttgcaaacgttggcaatgtctgctccggagaagccgggtgtttggcgcgacaggaattccacatctacacttttgtcggtcttcaacggtttaaggtgtacaaggaagatctctttgcggtcattcaggtcgggaagatctacatagatctggcggtcgaaacgtccggcacgcagcaaggcactatccagcacatcggcacggttggtagcagccagaatgatcacaccgctattggagccgaagccatccatttcggtaagcaactggttgagtgtattctcacgctcatcattgccggagaagttgttgcccttgccgcgagcacgccctacggcgtcgatctcgtcgatgaagatgatacacggggctttttccttggcttgtctgaaaaggtcgcgaacacgagaggctcctacgccgacaaacatctctacgaagtccgaaccggacaaagagaagaaaggaacgtgcgcctctccggctactgccttggccagaagagtcttacccgttcccggaggtcctacgagcaaagctcctttagggatctttcctcccagttcggtgtatttggatggattcttgaggaagtgaacgatctcttccacttcctgcttggcttcatgcagacctgctacatcgctgaatgtaacgtggatattggtcttgtcatagagcttggctttggatttgcctacgttgaagacgccgcctccaccgccacttcctcctccaccgccgctcattcggcgcatcatccaaaaccagaaaacgagcaaaaggatgagtgggccccatgtaatgaggatagaggtgaagctgaacttgctgtcttcatacttcaccttagccgtaatttggttttggtcgtagaagtcggagaatttgtctaccgacggaatttgcgtgttgatatagtagtctgagatatttcctctgtcctgaaaggacgggatgtcgcctttcttgaataccgaatcgaccttggccggatcgaccctcgccttgagagtgttctctttccgattgactacgatgtccgtaaaggcttgcttttttggcgatattctgaaactcaattccagctgagttctttctgggatgtaatatcccgatcgacaaagaagagggtggccaatatcagaaatacaggggcatagagccatatcgggttgaaacgcatcggttttccgggtttcttgttattcccattgttcgccatattgtttgcgcagttttattttttctacttaagaaaaatgcaggagtatttgttcgatactcgctgaaatcctgaaccataactttgcaaaagaacagccgacccgctcttttggtttatgtttctttcgccgggatatacggttattccgaatgccgtactgtgtttttgttatcgagaaggataaggatgaaagaaagacttcagacattgaagcggaaatgcatgatgtcgccatcctgcacaacatattcttttccctcaacactcatcttaccggcttctttcacggcttgttcgctgccaagactgacaaagtcattgtacttgatgacctcggcacggataaaccctttttcaaaatcggtgtggatgataccggcacactgaggtgctttgcttccgcggaggaatgtccaagcccttacctcatcgctcccggccgtaaagtaggtttgaagattcagcaagtgataagcggctttgatcagacggctcacgccggattctttcagaccgatctcttcgaggaacatttgccgctcttcgtatgtctccagttcggcgatctcgctctctatcttggctgctacgacgaggatttctgcatcttcgtttttgactgcttcgcgaacggcttccacatatttgttgccactaagagcagaagcttcgtccacattgcaaacgtacatgaccggtttggccgtcaggagaaagagttcgcgtgctatttgctgttcgtctttggtgtcgaaactgacgctgcgagcattcctgccttcgtcaagagcttctttgaatttcgagagcacttgataagccagcttggcttgtttgtcgccccctgtttgtgcctgcttttggactttctgtatgcgactctctatcgtttcaaggtctttcagttgtagctcggtgtcgatgatttctttgtcgcgtacaggatctacggatccgtccacgtgtgtgatattgtcatcatcgaagcatcggagcacgtggagtatcgcatccgtttcacggatattggccaggaatttattccctaacccttcgcccttgctggcgcctttgacaagaccggcaatatctacgatctctaccgtggttgggatcagccgttggggtttgcacagatcggccaggatattcagtcgctcatcaggcactgtgattacaccgacgttcggatcaatggtacagaaggggaaattggcagactgtgccttggcattggacaaacaattaaaaagagtcgatttccc

SEQ ID NO: 480 - DNA (genomic), 1286 bp, PORYPHYROMONAS GINGIVALIS; double-stranded, circular
  misc_feature 1...1286
  hypothetical: NO
  anti-sense: UNKNOWN
gcaatataaccacggaagacaaatggctcggtcaggctctttgtattgcttcggctgaaggaggcccatccgcagacaatggtgaaagtgatatccagcatgagaatataatcgccaatctgcttacccagtatggctataccaagattatcaaatgttatgatccgggagtaactcctaaaaacattattgatgctttcaacggaggaatctcgttggccaactatacgggccacggaagcgaaacagcttggggtacgtctcacttcggcaccactcatgtgaagcagcttaccaacagcaaccagctaccgtttattttcgacgtagcttgtgtgaatggcgatttcctgtacaacgtaccatgtttcgcagaagccctgatgcgtgcacaaaaagatggtaaaccgacaggtactgttgctatcatagcgtctacgatcaaccagtcttgggcttctcctatgcgcgggcaggatgagatgaacgaaattctgtgcgaaaaacacccgaacaacatcaagcgtactttcggaggtgtcaccatgaacggtatgtttgctatggtggaaaagtataaaaaggatggtgagaagatgctcgacacatggactgtattcggcgacccctcgctgctcgttcgtacacttgtcccgaccaaaatgcaggttacggctccggctcagattaatttgacggatgcttcagtcaacgtatcttgcgattataatggtgctattgctaccatttcagccaatggaaagatgttcggttctgcagttgtcgaaaatggaacagctacaatcaatctgacaggtctgacaaatgaaagcacgcttacccttacagtagttggttacaacaaagagacggttattaagaccatcaacactaatggtgagcctaacccctaccagcctgtttccaacttgactgctacaacgcagggtcagaaagtaacgctcaagtgggatgcaccgagcacgaaaaccaatgcaaccactaataccgctcgcagcgtggatggcatacgagaactggttcttctgtcagtcagcgatgcccccgaacttcttcgcagcggtcaggccgagattgttcttgaagctcacgatgtttggaatgatggatccggttatcagattcttttggatgcagaccatgatcaatatggacaggttatacccagtgatacccatactctttggccgaactgtagtgtcccggccaatctgttcgctccgttcgaatatacggttccggaaatgcagatccttcttggtccc

SEQ ID NO: 481 - DNA (genomic), 364 bp, PORYPHYROMONAS GINGIVALIS; double-stranded, circular
  misc_feature 1...364
  hypothetical: NO
  anti-sense: UNKNOWN
gctgtccgtttccctatcctccacgggcgcatggcttggggtggagtatcttccgagagcttggctcgcaggcatacggcacctcttacgaggagggtatcggcttcgtagataatatcctgtgggcggaagtagtagtaaccattgtctctcagcagggcactgatggtctgacgctcttcgtgcagctttgccaaattgaactggtctcctttcctgatcaaagacggagtctgcctgtaagccagaatgctgtcggggaaagtgctgatcggtaagggaatgatgctgtcgtaatgataaggagaggccatatccaccgtataggagattttggctttgagcgagtcctttttcagagtgg

SEQ ID NO: 482 - DNA (genomic), 2236 bp, PORYPHYROMONAS GINGIVALIS; double-stranded, circular
  misc_feature 1...2236
  hypothetical: NO
  anti-sense: UNKNOWN
tagaggatcccctggaaaaaattccttttcatttttgaccgcctgtcatcactgatcgctatgcctttttagcaacgtttccttcacttgggcaaagaatattatatctgaagtgaacagaacagccttttcgttttttaatatagagcagagcataatccgacctcggccattctttcagaaaaagcgaaccgcaatctcagaaataatggaacgagaatctgaaaaatctcacgccacaaagttttcattttggtttgaaaatttttcctttccgacgcaggaaaaaaatattttacgcgcgactttttgagtcctcttaagtaaggtattttttttaacatacttgtaccgaattatgcatctaaccatagtgtagaatcctcatctgtaggtaatttgcaccgaacaaccgatttgtcagtacattatgtctgacgaaacgcgtaattttgacttcaaatgaaagaaagattgaaccaaaccgtacgctattttctgcctatactcttcgcagtatatgccggcctggtcatatctttcactcacgtccatatcatcaatggcgtgatcatcgtccactcccacgtacagtggggcgacaacgaaagcgatccgcaggacaatccgcattcggattcggaattgattctgtacaatcagctttcggccatattcacgacttatttggatacgccggccatagacttgaaagaacctgtgagggttgtcggcgtcgttcctttcttttgcgataatcttactgctctcatttcggagctaactccttccaatcatctcagggctcctcccgtagcctgatccattcttaccttatttcggacgatccattcattcggatggtattgcgcgcgcttacaatgagatccgttgcatcggcacttgtagatctgcctttctatgctgatttatcaaggggatcgaatgtgcatccatagccgtgatgcaaggattttcatccttcttaataccgatcttatcgtgggatagggagtgggacacactctcctaacctcaaaaaccgactaaaaaggatcggaataaggataccgaacagacactatatccatatcaagccaatcaaaccaaaaaataaaatgaaacaactaaacattatcagcttcatcattgctttcctattcttaggaacgagcgcatcggctcagcaatcgggcggatccgttacaggtaccgtagtggacaaaagctcaaaagaacctatcgcatacgtacaagtattcgtcaaaggaaccactctcggaacttccacggatgcaaacggaaactactcgatcaagggaatcccttcgggtaatcaaactatcgtagcccgactcatgggttactccacttgcgaagaaaaagtacatatagaaaagggtggttcccgccacgtagacctctatctgaccgaagagattctctctctcgatggggtagtggtatctgccaatagaaacgagactttccgccgtcaagcaccctcgttggtaacggtactgtcgccggaacttttcctcaaaaccaactctaccaacctgagtcagggacttaagttccagcccggtctgcgcgtggaggacaactgtcagaactgcggtttcaaccaagttcgtatcaatggactcgaaggagcctattcgcaaattcttatcgacagccatcccatcttcagttcgcttgccggtgtctatggcttggagcagatgcctgccaatatgatcgaacgtgtagaagtaattcgcggtggaggttcggctctgttcggctctaatgctgtgggaggcgttatcaacgtaattacgaaagaaccgcttcgcaattcggccgagatcagccattctacgatgaccttcgaccacgcgaaagggtgggggagcttccaaaatacgacccagttcaacggttctatgctgacggaagaccgcaaagccggtgtcatggtattcggccaacacaactaccgtcccggacaggatatagacggcgacaactttaccgaactacccaatctgcgcaaccgctcgctcggtttccgctcatactataagaccggtctatacagcaaagcaaccctcgaatatcacagcatgcaggagtaccgtcgtggtggcgacagactggacaatcctcctttcgaagcccagatagcggaatatctccagcactatatcaatggcggaagtttcaaattcgatcagggcttcagcggggc

SEQ ID NO: 483 - DNA (genomic), 938 bp, PORYPHYROMONAS GINGIVALIS; double-stranded, circular
  misc_feature 1...938
  hypothetical: NO
  anti-sense: UNKNOWN
catcgaagttctattttcatcaagcgtccttacatctctgttgtgggcactattcagaagaagattctcggagaactttccaaaggtgaacgctccagtaatggctttatagaccgcattctatttgtgatgcctaatcttcagcagaaagcccgatggagcagaaccgagcttccagatgatacagagaaacgctggggaggtattattcgacggctcatagacttaccatgtgccaaggatgaagaaggggaagttacccctgagattattccctttgaagaagatgccaaagctcgactctatatgtggcaggaagagcatgctcgactatgcgatactgaggctaatgaagtacttgtaggagtctattgtaaattagaaatctacatcatccgtttttgtctcattattcagttggctcgatgggtatgtggcgaaagtgaaaagtccgctatagacctgacatctgtggagcgagccatcactcttaccgagtatttccgccattcggcacagcaagtacacgcagagatcgcaggtgttcagctcactcagcaacagcaacaactccttgccgagctaccagcatcttttcagactgccgaagccctgagtattgcccaaaaattggggatgaaagaaagagcttttaaggattttctcagtcgtaatatcggacacctctttgctaaggaacgacacggactttaccataaactcaatatgtaaccgagcgcactttctgcattatcagcatttcgccaccccttattaaaccgaaagtgtacaaagtgcagatagtgtgccattcaaatcaattttatcaatgagcaattatagattcaaattagaaccatacaaaggtgtgcggacacggcatacctgcccatcgtgcgaacgtcctcgatgcttcgctcgctatattgacacagagg

SEQ ID NO: 484 - DNA (genomic), 956 bp, PORYPHYROMONAS GINGIVALIS; double-stranded, circular
  misc_feature 1...956
  hypothetical: NO
  anti-sense: UNKNOWN
gaagacgatgtgacggaggaggaattgctggcctgcgtgcatcgcctgaatcaggatccgacggtagatggcttcatcgtacagctccccctcccgaagcatatcgacgagcagaaaatcatcgaagcagtagacccgcgcaaggatgtggacggatttcatcccatcaacgtaggccgtctgagcatcggtttgcccggtttcgtctcggccacaccgaagggaatagtggaactgcttcgtcgctacaatatccctaccagaggcaagcattgcgtagtattgggacgcagcaatatcgtaggcaagcccgtatcgcagcttctgctccaaaagggagagccgggcgactgcaccatcaccatctgccatagccgtacccctaacatcaaagaggtatgtctgacggccgacattattattgcagctttggggcagcccgaattcctgacagccgatatggtaaagcccggagctgtagtagtggacgtaggtaccacgcttgtaccggactcgacacgcaaaagcggtttccgtctgacgggcgacgtcaaattcgatgaagtggcccccaagtgctcgtacatcactcccgtaccgggcggagtaggtccgatgaccatcgtatcgctcatgtccaatacccttctggcaagtaaaggattgtaccggtaaaccctccttcccttatttgccaacgaccttatcgaagaggcccgtcatcaatatcggttcgtccggtatgatgatcggcctcttttcttattgacagtgtgtcatcatgcgcaaattgctgcgttgcttgcggcattcgtttcttagcgccttgnactttacgcattcttacccacctaaaatggggtatgccaaaaccgaattttgacacgggctccctcctgccgatactttcaagaattcgcttcgtatcctttccgttaggaggtaaaggcgtactt

SEQ ID NO: 485 - DNA (genomic), 540 bp, PORYPHYROMONAS GINGIVALIS; double-stranded, circular
  misc_feature 1...540
  hypothetical: NO
  anti-sense: UNKNOWN
cctgcaaatcgcggctctctatatcaatttgctcttccgtcaggaaatgactcgtacggcagaaacacagttggcactgattcgcgagcaacgcaatcgcacggccgaaatggttcgcgtaggtaaatgggcagagggtaagctcctcgacataaatgcccagatggccaaggacgaacaacttctcgtacaatatcgttcggaggaggagctggctcgtctggacttggggcaagccctcgaactggagcaccccgaaagcattgcagtcaaggctcccgacacagacgttctcgtagcagaaaggttgggatctctccttgctcccgaagagatctatcgcacggctctcggcttgaaaccggcactgcattcgagcgagctgcaaatagcttcggcacgcgaaggtctggcctcgctcgtgcggcatacttccgacgctcagcctctctgccggatacagcaacggttactttccgcgacctcggcaaggagtatgccgccatcaaccccttcttctccgaacagtggaagaacaac

SEQ ID NO: 486 - DNA (genomic), 583 bp, PORYPHYROMONAS GINGIVALIS; double-stranded, circular
  misc_feature 1...583
  hypothetical: NO
  anti-sense: UNKNOWN
agagaaagattcttatgaaaagaccttgctgatgtctgctcgtaagcatgatattgtagccatcaggatattcgatcggcgagaggccgatctgccaaatgtagggttgatgcgctttcgcgatgcagagacagggcagactcattgggtggataccgctgatagctccgttcggaaagcgtatgcggatgcctatgagcgacggcaagtagcacttgccgttttgctcaaacgatgtggtgtagatactactgagatacgtacggggcaggatttcgtgcagcagcttcttatcttatttaaaaaacgctcatgagacactctcttgccattcgctttgttctttctgcattttgcatgctctttgtctcttcctttctgaaggcgcaagagctttctatcataggcaaactcgaccgtgcagagatgcaaataggagagcaggcagtgatagatattactatccgcacggcagatttggcgcatactcatctgcaaatacctactgattcgacgatgagtcggatcgaaattttggcctttggcattacggatacgttgttgtgaaagatccgatcgtgga

SEQ ID NO: 487 - DNA (genomic), 613 bp, PORYPHYROMONAS GINGIVALIS; double-stranded, circular
  misc_feature 1...613
  hypothetical: NO
  anti-sense: UNKNOWN
tatattgaaaatcggtgataatatccttaacatataggaagttattcgaccaatatctaccatcttgacgaatagttgatgtttccacgattgaaatcaagtacccgtcctctgattttgtattaaaaattaagcaacctttatccaagtgttttgtactcaagcctaactgaggtttgatggaatattctccattttcataggatacggttaaaaagctatctttagcttctgttttgagaagcataagtgcatcaactgtttcattgttaagcatgcaaccatcaatgtaaattatataaaactcaccattagcaatattagggtgtatgctttgatcataaaggtgtctagcaagattgttagattgttcaactatatcatctttgtcatcaaaantcttgtgtacaaatctatatgacggattcatgtctaaagactctatagaatcaaactgacagaaaacatcaaacttgaatgtgttttttactaatgttgaaataaatccagaagcaaacgacatatcatctgctttagaagaaaatgctataccttcttcttttaacttattgccaacctttgtactgtggcgattgtagggactcctaattaa

SEQ ID NO: 488 - DNA (genomic), 545 bp, PORYPHYROMONAS GINGIVALIS; double-stranded, circular
  misc_feature 1...545
  hypothetical: NO
  anti-sense: UNKNOWN
gaaagcagcaaaatgccatacaggcatacgaagaattgctaagtctcgatcccttcaacgaagaaggtcactgcggtattgctacactcatgatcaaagaaggacgatcagccgaagcagaaacatttctgcgcgaagctatcgaagagatgccggttcagcgcaatctgattctgatgctcgtcgaaatattggagaataaaggacaaacgcaggaagcagcagaatggcgtgccaaactaccggaagcagaggtggaaagcgaagcggttaatttcaatgatctttacaagggtaacctctattaacttctttcaaattaacacctgacctcgatggcaaagaagtggtatgtggtctggaccgggcatacacccggagtttatgataattgggatgaatgtcgagcgcaaacagagggattcaataaagcccgctacaaaagctttgctaccgaaagcgatgccctaagagcctatgaagacggagcagatgaattctaccgcagaagcatacggatccactggtaccgcaccggagcanac

SEQ ID NO: 489 - DNA (genomic), 716 bp, PORYPHYROMONAS GINGIVALIS; double-stranded, circular
  misc_feature 1...716
  hypothetical: NO
  anti-sense: UNKNOWN
cgactctcgaggatccccgaggagacgacggacaggtgtcccgcttcggtgggggattgaaccctgctacgatcctccagaacgagtacgtagctgtctgcattattttccatatactactgcgattataaggttatcgcagcaaagatacgcgaggcaaacaggaatgatgaagatgggtttcttagcgtttcttagaatggattagaatggaaaagccgtgtatctgttccaatttctggcttgccggatgcagatttatgttgactgcagaaagaagactgtagtaatgaatgaatatcttaaaaatggaccgcgctatggggaaggaaaccagctacggcaaaaagacaaagcaataccatgccaatggctgtaatgctatatcggacgagtggattataatgtataactgagagacaaaagaatatgcccaggcaatcgtctgtataggatagttgattggactgtcggggtaaggatttctttcatccattcattatctttaagatggaacacattctctccttgcaatttgatgtctaacttgcttaatttgtatttcagagagaagtccaaatccctaaaatagcgcttggcttcggcatcttcaattctattcgacttgccagaaacagaaaaaacaaaatttcctatatttacatgagttgntgcgaaacctccaaattcttgattccaagagtggatattgctgt

SEQ ID NO: 490 - DNA (genomic), 686 bp, PORYPHYROMONAS GINGIVALIS; double-stranded, circular
  misc_feature 1...686
  hypothetical: NO
  anti-sense: UNKNOWN
tagccattgctgttatccgaagcatgaggctggctaataagaccataaggaattttcgtcctgatatggtaatcggtgtaggaggctatgccagtggcccaaccttacgcagagcacattccctcgggatccccaccctcattcaagagcaaaacagctatgccggtgtaacgaataaactgctgagccgaggagcgcataaaatctgcgtggcttatcccgaaatggataaattcttctctcctgaaaagatcgtttttaccggcaatccgattcgccctgaaatagaattcggccaccccagccgctcggagtctcttcgctttttcggcttcgagcagtccgaatcgcctgtcgtcttggtggtcggaggtagcttgggtgccctgactattaacaagagtatcgccgacaagctcggcaaatgggcagaaagcggtgtacaccttatatggcaaacgggaaagaactatattgagacagccagaaaagcagtagagaatcatcccgggttgaaatgctatgtcaatgattttatcactcgaatggattatgcatactgtgcagccgacttggtagtgtcacgagccggagcttgctccatttcagagctttgcttgctgggaaaacctacgatactggttccctcgccaatgtggcagaagaccatcaaacaaagaatgctt

SEQ ID NO: 491 - DNA (genomic), 568 bp, PORYPHYROMONAS GINGIVALIS; double-stranded, circular
  misc_feature 1...568
  hypothetical: NO
  anti-sense: UNKNOWN
agagcaagttttccatctcgctgcctcgtctgcgtcctgccacgggcggctgggagcctaaagatcctattgacgatgtcggtatggtacagcttattactgccttccgtctgttggataaggatgtcgagatcagcctgtccacacgggagagtcgtgagtttcgtgaccacgtgatgccgctcggtatcacctcggtcagtgccggcagcaagaccgaacccggaggatatgccgaagagaatgccgatctggagcaattcgccatcaacgatgcccgcagtccggccgaaatggctgccgatcttcgccgacttggctacgagccggtttggaaagactgggatgctttcatgtaacagaagattcttaccgtaacgcctcgcgtccgaagcgaagcgatcttcataagaataaaggcttgctctccggtcgaggaaagcagcctttgtccgtttttggttttatcgtttgaatccttacaagcgaatacctaagcctacgtggaaagaggtattctttcagcgtagcctncaagtttttagtctcgggtttaatggctttaccg

SEQ ID NO: 492 - DNA (genomic), 602 bp, PORYPHYROMONAS GINGIVALIS; double-stranded, circular
  misc_feature 1...602
  hypothetical: NO
  anti-sense: UNKNOWN
tacacgtgtcaagcccgtgcaactntccgctttgctcgtaacgatacacagtcccgaactcggcccaaacgaatcggtagatcgcgataggaatgtggagtgatcntgaatatctcgcagtggtgagggcattcattggctttagcatgaactcttctccttcctgcggcgtattgatcggacggaaagaatcctgtccgtatttggcatagtgcccggaggtgatgtagagattcttattgccgatatgcggcgtgattacctgttggtagccaaagtgcttctgtatctgcttcagaaagtcttccaaacgcaaacggagctgtgtgcctcgcggtagccaaagcggcaagccggcacctacattttgggagaaagcgaagagttcgagctccttaccgatctttcgatggtcgcgcttcttagcctcttccaaaagctcgagatattcatccaacatctttttctttgggaaagagattccatagattcgtgtcagctgttttctcttttcgtcgccgcgccagtaagctccggctacacttaaaagcttgatcgctttaatgtaaccggtattgggtaagtgaggaccgcgacaaagg

SEQ ID NO: 493 - DNA (genomic), 2821 bp, PORYPHYROMONAS GINGIVALIS; double-stranded, circular
  misc_feature 1...2821
  hypothetical: NO
  anti-sense: UNKNOWN
ggttcctccccaccatctataaggcgcgccagccagtaaatagccgcgtcgggatcactgccccgaatacttttgataaaggcggatgctatatcatagtggagttcgcctcccttgtcgaaagcagcggggttttcttgcaagcgctgacgtatcttttcgttggtaatgacgagccggtcttccacttcgcttgtggccagaaggtcgaggatgttcagcagctttcgtgcatcgcctccggcatagagaagcagagcttccgtctcctccagtacaggatgcttggcagccagcagttcgtcccgatcgatagccctgtgtgccaagtagcagcagatcctcatcactttggggtttgagcacatagacctgacagcgcgataggagcggacgtattacttcnaaactcggattttcggtcgtggcaccgatcaagcgtcactattcctcgctctacggctgccagaagtgaatcctgctgactcttgctgaaacggtgtatctcgtcgatgaagaggatggcgcgtcctcctttgtcgaacagattgccacgattggattcgatgtcggctattacttcccgcacttccttcacaccggagctaaccgcactcaatgtatagaaaggtgcatccacttcatgagcgatgatttcggccagcgtagtcttgcctactccgggaggcccccacaggatcatggatggcgtctgtccctgctcgatcatctgccggagcacagcccccgatccgatcagatgctgctgccccacatagtcggccagcgtttttggacgcattctctcggccaagggtatttgtttcatgccgctaaggtacataattgggatacgatccgcatgtacgcgagtggaaactgccattaaacgggaaagcgagaggaaagtctatagaagtatcatttccttatttttacagagcagatcaatcgctaaaaagacgaagaatacccatgccacaccatctgttgtcattgacttccctgctgaggtgcagacttcaccacttcttcctatatattattataatagtatcggcaggctattcagccacggcacaaacggtgatcaaaggtcttgtcctcgcagcggacaatgaagcccccgtatcttatgcatccatctatgtcgctgaaacaaagagcggagtagtggcggacgagagcggacgatttatcctccgcctccatccgggacgctaccggctggccatccgttccatgggatacactcctcttgagacagagttgctcgtgggcgagaaaagcgaggagaagactttccgactcagctccgtcatctatgatctgaaagaggtggaagtgataggtaaacggcctaaagaagatcctgcctatcccatcatgcgcgaactcatagcgcgcactccagtttacgagcacatggtaaagagctatcaggccaaagtctataccaagggttcgatgcggctggataagctgcctttctggctacgctataagaaagcagatggcataagtgcaaaggatctggagaaaaaacgcttcgtcatagagagccaagcctctctggaattccggcatccgaacaaatacaacaagcaagtgcgcgcgatgcgctcttcgataccggatgacctcaaatctgatacaacggattatatgcagattatctcgaccaacatatatgccaaagagttcagtcttgatggaatagtaaacatggcaagtcctatacggacgggtgtactggaatcgtacacctacaaactggagggtaccagccgggaaaaggaaagaaaagtgtaccacatcagcttcaaaggcagaaagggacgccatgaggggcgaactgtgggtgatcgatagcatctggtgtctgcaggcactaaaattggaaattaaggcttacgatatgattcggtacaaggtcgatataagtctcaatccgctcgaaaaggatgtgtacctgcccaccacctatgccatcggtatggagatgcagtcgatgggactgaaactggagtaccagtacttttcgtccttggtgtacgattcgcttgagatcgaccgcaaattgctatccactgcccgaagagctgagggacttcgcttccgtacgaaccgcgaagtaaaccgccaccttcggatgctcgaatcccgattggatacgctgggctatcatctgcccgacaagtatatgctgcccgataccgaattgcaggccaaggtccgattcgattcactagctttcgatcgcgactcttcctactgggacgctgtagtgacggcaccgcttaccgatgaagaagcacagagctatgccaatcgggacagtctgatgcaagcttttgagaaaaagcggcggttcggtggcggtcgggaaggcgaacgtaccggccgtacttccatcctcggtgctatcctcggcggacatgactataaaatgggagaggggactacactcggattcaacggccttatccgcggatcgctctatgactaccgctatacggatggcttttggttgggacagagctttttcttccggcagaagttttccaaaggtgtagacctgacgctgcgccctatactatattatactactcataggcggaagctatactgggatgtccgtgccgatttccgctacgctcctctctcgggtggactactctccctatcggcaggcaggcagagtgcagacctgactggcccgtttgccaatacggactggcgcatacagactttcctgaccaccttagtagacggtcgtggtcatctgatgctatatgacaagaagtatctgcgcttgagc

SEQ ID NO: 494 - DNA (genomic), 593 bp, PORYPHYROMONAS GINGIVALIS; double-stranded, circular
  misc_feature 1...593
  hypothetical: NO
  anti-sense: UNKNOWN
ggctctaaacctgcaaaccgctttcgagcagataagacctccggacacagtacagaaatcagcgtgatgcaatggatgatatcttctatggaagcagcatctgtgaatggtagcacaagagaataatctttgccgagacagcgaaaatcaatctcggtgcgattatctttcgattccaatctgcacacatacaaatgagcttcgggcttcgtccggctccatgaaactccggctcttgccaaaccgcagaaagagatagcagcagctatctcttcgcagtcgccgttatagacaatagtatgacaatggagaaacaagcggagcttttcctccagtttcgtttttatatccgggaagttctcctgatgagcacctcctatattcgtaatgataccatacgaggggcatattatgctctccaaacgttccatttcccccatttgcgatatgccggcctcaaatataccgagagtgtgttcctccgccattgccatacggaaaggggtactcctatctgcgagttatagcttcggggcgagcggacaatgcgatagtccttgcgcaataactgataaaggaactctttgacgatg

SEQ ID NO: 495 - DNA (genomic), 557 bp, PORYPHYROMONAS GINGIVALIS; double-stranded, circular
  misc_feature 1...557
  hypothetical: NO
  anti-sense: UNKNOWN
tgaacaaagaagctctgtcctatcgtttggccggcaaggacattgcagaagtgaatgcaatggacatcaagactcttattgaatgggtagattctctggatgaacatctgttggatacgcaacgggctatttctatagaaatactgaaagagatacggacacgcttggggtttcttaaagatgtggggttggagtacttgacgatgaaccgagctgcagcatccttatccggaggagaaagccagcgtattcgtttggctacgcagatcgggagcaaactggttgaggtcttgtacatattggatgaaccgagtatcggtcttcaccaaagggacaatcttcggttgattcattcgcttcaggatttgcgtgatataggcaatacagtggtagtggtggagcatgatcaggatatgatgctgcacgccgactatgtaatagacttaggaccacgagccggcagacatggtggtgaagtggtgtttgcaggtagtccggaagagatggtgcaggctaataccctgactgccgattatataagtggacgaaagcgtata

SEQ ID NO: 496 - DNA (genomic), 1046 bp, PORYPHYROMONAS GINGIVALIS; double-stranded, circular
  misc_feature 1...1046
  hypothetical: NO
  anti-sense: UNKNOWN
ccttagctgtcccgtcgagcttggtcacggcaagggcattcacttcagtcgctgcggtgaactgccttgcctgttcgaaagcattctgaccggtggatccgtccaataccaataaaatctcatgcggagcgtcgggcactaccttctgcatcacacgcttgatcttcgtcagctcgttcatcagattgaccttattgtgcagacgtccggctgtatcgatgatcacgacatcgacgccgttagccacggccgaactgactgtgtcataagccaccgaagccggatcgctacccatctgctgcttgatgataggcactcctactcgctcggaccagatctccaactgctctacggccgcagcacggaaggtatcggcagccccgagcacgacgctcttgccggcctgacgaaagcgatgtgccagcttgccgatggtagtggtcttgcctacgccgtttacgcccactaccatgatcacataaggtttggtaccggagggtaggtcgaagctgtcgccatcggccgatccgttctccgtgagcagcgaggcgatctcttgacggaggatagtcgtcagctcggaggtggaaacatatttgtcgcgagccactcgttcctctatacgtttgatgatcttcaatgtggtatcgacacccacatccgaagtcaccagcacgttttccaattcgtccaagacctcatcgtccactttgctcttaccggctacggcacgggtgatcttggcgaatacgttttctttggtcttggacaggccttcgtccaaagtctcttttttctttttcgagaataatccgaataatcccatatcgtatatactgttatatctcttccttagttcattctgttcttgtaatcctcataatcgaaccggcgcaacacctctttcttcccgtcggtgcgcagcagtacgatgtccggatggcgtgcaccgttgaacatgtcgtcttcaccgcggtagtggagcatgtctcgaatatcagtcatcgccactgcacgcgatcgaaactcagtcaccgatgaagcgc

SEQ ID NO: 497 - DNA (genomic), 5884 bp, PORYPHYROMONAS GINGIVALIS; double-stranded, circular
  misc_feature 1...5884
  hypothetical: NO
  anti-sense: UNKNOWN
gcaaggagttcggcttcggctttcgctatggaatcctgccgagctgcttctatcgcagccttacgctgcgcttctatttcctgcggatcgggacgattgagccatgaaaacccaaagatcaccagtccgatcagaactaaacctataactgtatttttatccatatattttcgttgcgtagggattcttcggcaccgacatcggcacccctatcttgttgcctgttcgctacggtatgtcagaggggaggaaaaatttcacacccccccaaagaaccgacaggcaaagcgattattctttatctttttttctcgttttgattgcttcacgaatgaaagccatgaacaaggggttgggattgaccaccgtactattgtattcgggatggaactgtacccccacgaaccagcggcaggcaggcacttccacggcttctaccaagcccgtctccggattctcgcccacacattgcataccggctttttcgaaagcttcgcgatactggctgttgaattcgaagcgatggcgatggcgttcgcgcacgaattccttgccataggcagcagccaatttcgatcctttgcgcagagcacagtcgatgcgcccaaacgcatggaaccgcccatatccgtaaccgtcttctgttcgtccatcaggtcgatgaccttgtgctcgatattggattcgatctccgtcgtattggcgtccttgaagcccaatacattgcgagcatattcgatcaccatacactgcatacccagacagatacccagtgtgggcagatcgttctcacgcgcatatttcagtgctatgagtttgccttcgacccctctggaaccgaatccgggggcgatcacgatgccgtccatatctttcagggtctcggctacgttagcctccgtcaccttttcgctgtgaacggatatgaggttcagcttcttcctattatatatagccgcctgcatcagcgattcgtctatggacttgtacgcatcctgaagctccacatacttacccaccaaagcgatcgtaaccgtttctcgggccgtatgcttcatttccaaaaattcatgccactgacgcatctcgggcacaggtcccacttgcagccccactttccgaagtaccgtctcgtccatatgctgctgctgcaagaccagaggcacctcatagatagtaggcacgtccacactctgtaccaccgaatcgggagccacgttgcagaacagggctaccttcttcaaaatgtcgggctgaagctcgtgctccgttctcaatacaaggatgtcgggctgaatacccacttcctgcaactgcttcacggagtgctgagtcggcttggtcttcacctcgccggcagcagcaatgtagggtacataggtcaagtgaacgcagaggcaattctgccccaactcccacttgagctgacgcacgctttcaaggaagggtagggattcgatgtctcctaccgtaccgcctatctctgtgatgacaaagtcgtactgactcttttgtcccaggagtttgacgttgcgcttgatctcatccgtaatatgaggcaccacttgcacggtcttgcccaagtactcgcccttgcgttccttgcggattacgttctgatagatcctgcctgtcgtgatattattggcacgagtagtgggcgtattgaggaaacgctcatagtggccgagatccaaatcggcctcatgtccgtcctcggtgacatagcattcgccgtgctcataaggattgagcgtaccgggatcgatattgatataggggtcgaacttctgaagagctacgttgaaaccgcgagcttggaggagtttgccgagagatgctgctacgatgccttttccaagagaagaaaccacaccaccggtcacgaagatatacttagtatctgccatagcgcgaaaagatagtattgttgatactttgatcgataaatcaggggtacggaaagctaccccgaacggaccagcctcctccgattcgtgcgcaaatatacaaaaagaacgcctgctaaaagaggcaaatacgacagctcttgcccgatgccggcacatcaaaatgagaaatgaggcatccgacgaaccgcgataaggctatccgaggcaaatttacgcgccggaaatgctccgattgcggttcgtaaattctcgaaaacacgcgcgagattttttccgttttggttcgggaaacaaaaaatttacgcgccaaagcgaaaattttctcgcgccacgtttttacgaacgacaatggagccgattttggaaccgagacggcaatatgagcagcatgccccacgagtcgttttttcttctcgcaggataaggtatttccttagctggataagaaggaaatgacaccaaccgattcatagcaaaaagcatggttttcattccgacaacaaggtgtcacatgatgagggcaaactcgatcgtaatgctgccggcacgttgttcgaatctgcacctgcgatcaaagattggctgtttgggaaaaagcatataaatttggcaggaaatttcagagtttcactcctaatactacatcagaacatggctgtcttcatcaatgaagtttccaggacgttcggcgaatatcttcttattcccggcctcactacagaacagtgcactccccaaaacatctctcttcagactcctctcattaagttcaatcgcgatgagagtccccgtatcaagctgaatatcccgtttgtttcggccatcatgcagtcggtctccaatgatacgctggccatcgaattggcacgcaacgggggactttcgtttatcttcggatcgcagagcatagagagtcaggccgaaatggttcgtcgtgtaaagaaattcaaggccggatttgtcaccagcgattccaatctcagaccggacaatacgctggccgatgtattggatctggtcaaaaggacaggacataataatataggtatcactcacgacggttcgtccaatggccgtctgatgggtatcgtcacgagcagagactatcgcgtcagcacggactcaccctcgaagccggtcaaagattttatgacgccgttcgagagacttacggtgggcaaggtcggtattacgctgagcgaagccaacgatattatttgggaaaacaaactcaatacgctgccgatcatcgacgaaaatcagaatctgcagtatttcgtcttccgtaaagattacgacagccacaagaacaatccgctcgaactctccaactacacggacaagaccctcctcgtgggtgccggtatcaatacacgcgactataaggagcgagtacctgcactggtggaggccggtgtggatgtggtgtgcatcgactcatcggacggctattccgactggcagagcaatacgatccgttggatcaaggagaaatacggggacagtttgcccgtaggtgcagggaatgtggtcgatcgcgatgggttcaacttcttgaccgaggccggtgcggacttcatcaaagtagggatcggaggaggctccatctgtatcacacgtgagcagaaagggatcggtcgcggtcaggcaacggctgtaatagacgtagccaaggcacgtgacgactattaccgacgaacgggcacttacgttcccatctgtagcgatggagggctcgtacatgactaccacatggtgctggcattggccatgggtgccgatttcctgatgatgggacgctatttcgctcgattcgacgagtcgccgaccaagaagatgaagataggcagcaatatcgtcaaagaatactggggcgaaggatcgaaccgcgctcagaactggcaacgctacgacagcggcggcaccgagacgctcaagttcgaagaaggagtggacagctacgttccatacgccggtaagatgaaggacaacctgctcatcacactcggcaagatcaaggctacgatgtgcagttgcggtgtcattaccattcccgagctgcaagagaaagccaagattaccctcgtgagcagcaccagtatcgtcgaaggcggtgctcacgacgtcatactcaaagatcgcggatgataacgatcttggggcctacggcatgcggcaagactcgtctggccgtaagcctcgcatatcggttggaaaccgagatcatcagtgccgactcgcgacagatataccgtggcatggacatcggcacaggcaaagacttggccgactatcaggtgggagggactacaatcccttgccacctgatcgatataagaccggcaggggacaaatacaacctctttgcttatcagcacgactttcaccaagcctacgcatcgatcctcgctcgtggcatggatccgatcctctgcggaggtacgggtatgtatatcgaagccgtgctcaaaggctaccacctccccgatgttccgcccaacccgacgcttcgtgatcgtctgcaaggaaagagtttgacagagctgactcttatactggctgcatacggccctctgcacaataagacggacgtggactcggcacagcgagctatcagggctatcgaaatagccgaatacatcaagaacaatccggtcgaaagcaccgagtttcctcctatcgacagtctgattatcggtctcgatctggatcgcgacacccgacgcaaaaggataacggacaggctccatgcccgtatgcacgagggtatgatagaggaagtcaagggacttctcgacagtggcattccggccgaggatctgatctattacgggctggaatacaaattcgtcaccttgtatctgacagggcagacggactacgaatccatgtttaccggactcgaaacggccattcaccaattcgccaaacgccagatgacatggttccgtggcatggagcgtcgcggattccttattcattggatagatgccctgctccctgcggacgaacagtgtgaagccgtcatgaagctctacggagccaacgggtaaaactttttcctgaccgaatcctccttttttctgccaacgagcagatgactacacgtacaatcctgccattctgacagcgaataagcacattccgacaggaatcagtcaggaaatcggcattggtatagctattgacataaaaattgcggagctacataagaggcttcccatttgtacaggcaaacaatcaactaacaataacaaaccaagcaacaatgaacatcaaaccattggcagaccgcgtacttgtaaagccggctgcagcagaagaaaaaacagtgagcgggatcattattccggattcggccaaagagaaacctctcaagggtgaagtaatcgctgtcgggaacggcacgaaagacgaagagatggtgctcaaagcaggagacaccgtactctacggcaaatatgccggcactgaaatagagctggagggtgaaaaatatatcatcatgcgccaaaacgatgtcttggcaatcatctaatgggcaaaacaaaaaaatcagaacaagttaacactgcaggttggccttcaaaaacaggaaaccccagtggtaaaggaagagacaataatcctccaaaaaagaaaaaaataaataataaagactatggcaaaagaaatcaaagaacaagttaacactgcaggttggccttcaaaaacaggaaaccccagtggtaaaggaagagacaataatcctccaaaaaagaaaaaaaataaataataaataataaagactatggcaaaagaaatcaaattcgatatggaatctcgcgaccttctgaagaaggcgtagatgcactggcaaatgccgttaaagttaccctcgggccgaaaggtccgtaatgggtatccttagccaagacgtaccggagcttccggacattacccaggaccgtgtgagccgtaccgaaagagat

SEQ ID NO: 498 - DNA (genomic), 394 bp, PORYPHYROMONAS GINGIVALIS; double-stranded, circular
  misc_feature 1...394
  hypothetical: NO
  anti-sense: UNKNOWN
atagggtgagcttatcgcaggcgttcggctgcccgtatcatggcttcatccgctcctatgccacgaatggccagatagtgcaggatgatggagactatcggcatgcagagccaaaaacggaatccgaactccaagttctcagccgagcatatctgccaaatctgcatccccagatagataagaaaacctatcgtgacgaggatattgaagatacatagtctgatctgcaagattcgctttttgtagaggaagatggtagcaaacgagatcagtacgataatggcatcaagagcaaaaagaccccaagtggacttgaccagcgcattggtagccggtgcatatagtcctaatatggtcatcgcgtatccttggccttccggccttatcaaaagcc

SEQ ID NO: 499 - DNA (genomic), 594 bp, PORYPHYROMONAS GINGIVALIS; double-stranded, circular
  misc_feature 1...594
  hypothetical: NO
  anti-sense: UNKNOWN
cggtttggatttggctctcggtgtaggcggttaccctcgcggacgtattatcgagatatacggaccggaatcttccggtaagaccactctggctatccatgccattgccgaagcgcagaaagcaggtggcttggcggccatcatcgatgcggaacatgctttcgaccgcacctatgccgaaaagttgggcgtcaatgtggataatctctggatagcacagccggacaacggtgaacaggctttggaaatcgccgagcaactgattcgctcttctgctgtcgacattatagtcattgactctgtcgcagccctcacgcccaaagcggaaatagagggtgaaatgggggacaacaaggttggtttgcatgcccgtctgatgtcgcaagcactgcgtaagatgaccggagccatcagcaaatccaatacaacctgtatcttcatcaaccagctacgagagaagatcggtgttttgttcggcaatccggagaccaccacaggggggaatgcactgaaattctatgcatccatccgcatcgacattcgcaagagcacaccgatcaaggatggcgaagagatcatgggacacctgaccaa

SEQ ID NO: 500 - DNA (genomic), 639 bp, PORYPHYROMONAS GINGIVALIS; double-stranded, circular
  misc_feature 1...639
  hypothetical: NO
  anti-sense: UNKNOWN
gtggctccggaagcgatcacagcttcttggactatattttttcgttagatggtggagtacactttgagcaaaagcgtatttacacaagaccccaaaaactgactatcaatagagtagacctttcattaggcagtacatctccttctcttggatttaatacttggccactaatgggagtcgtattcgaaatgaataagaaccttgatggcttcgacattggtttcatttccaactttgtggactatgatccccgctatgcgtggtctgaaccgataataatagaagaagactgtggatggactgattttaatcctttgngagcactaagtatagagatccaaatgatgttggatgacaattcggataataccgtgggtggagaacgctcccataacttcctgatcacttacccgggccattacgtatatccgaagcaatctttcaattattctcccggacatacaccgacaaagaaagatctggtctttaaacactgtataggtattccggctttggcataccgataaggaaggcgatcgttatctggactacttttcaagatcaccaatctaatgagatacagatgggatcaaatacgatgacattactctttttatggttggagttggncatatgtat

SEQ ID NO: 501 - DNA (genomic), 1372 bp, PORYPHYROMONAS GINGIVALIS; double-stranded, circular
  misc_feature 1...1372
  hypothetical: NO
  anti-sense: UNKNOWN
ggccgactgggcttcctcaccgatgtcgattgccacgaggcttcggagctgatcacacgcctgctggacggcgacttcaccatcgagacccgttccctgctggaagtgaccgaagacaacggctcctctccctcctacgccctgaacgaagcagccatactcaagcgtgaaaccggttcgatgattcgggtgaatgcctgcctcaacgacgactatctggcggcttacgatgccgacggcctcgtggtggccacgccctccggctccacagcctactcgctgagcgggaacgggcctatcatcatgcctgcctgtcggaacttcgtccttacgcccatcgccccccactcgctgaatatgcgtccgctggtcgttccggacgacacggtgatccgcctcgaagtggattcgcgcagtcggaattacctcttggtgctcgacggacgaaccagaacgttgccctgcgatacctccatcctgctcaaacgagctcctcacacgctgcgaatgatccgtctgcgtccgcactccttcgccgaaaccctgaggcgtaagctcatgtggggagcagccgtaagataaagacacttgcgacggtggacaacgagccaacggacacttaccatagactactcccataatggaagaaaatacaaccatggtgctgcgcaccgaagatctggtcaaacgctaccggaaccgtacggtcgtgaatcacgtatcgatagaggttcggcaaggagagatcgtaggactgttcgggccgaacggagccggcaagacgacgactttctatatgaccacggggctggtcgtccccaacgaaggacggatattcctcaatgatcaggacatcacccaataccccgtctacaaacgagcgcgtgccggcatcggctatctggcacaagaggcatccatattccgcaaaatgtccgtggaggacaacatcctctccgtcctcgaaatggccggactgcccaagacctatcagcacgaaaagctggaaagcctgatagccgaatttcaccttgagaaagtacgcaaaaaccttggcgaccgcctctccggcggcgagcgacgccgtgccgagatagcccgctgcctggctatatcgcctcgcttcatcatgctggacgaaccctttgccggtgtcgatcctatcgccgtacaggacattcaggccattgtggccaaactcaaggacaaaaacatcggcatcctcatcaccgaccacaacgtccacgaaacgctcagcatcacggatcgcgcttacctccttttcgagggcaaagtgctgtatcagggcacggccgaagagctggctgcgaacgaagtcgtaagggaaaagtatctgggacgcgacttcgaa

SEQ ID NO: 502 - DNA (genomic), 2931 bp, PORYPHYROMONAS GINGIVALIS; double-stranded, circular
  misc_feature 1...2931
  hypothetical: NO
  anti-sense: UNKNOWN
gctcgggacggatttccgtcggcacctggaaggtagcaccaccgatacggcggctcttcacttctacctgaggagtgatattatcgagagccgccttccaaatctcgagggcagacttctcttcgtttgagtgcttcgtcttcacgatgtccaaagcaccgtagaagatactgaaagctgtgttcttctttccatcatacattaggtgattaacgaacttagtcaccctcacatcaccatagacgggatccggcaggatctgtctttttttaggttttgcttttctcattgtctcaaaaaatttcgtttttgtcgattggttgccgtttcatttttgtcttcaacgctcccgccggagcatttactcaaccctgtttaagcctatccaattgaactcaaaaccggttcttaaataatttgttggttgcgcccttgatcgtagcgcgattgtagattggggaagtgattcgtccttatcggtctccggcctcgctcatcgaggccgacgagtccgcttagcggctcttacttcttacctttagcggcaggagcctgtccgggcttcggacgcttggcaccgtatttggaacgacgctgcgtacggccattcacacctgctgtatcgagcgtgccacgaacaatgtgatagcgcacaccgggcaagtccttcacacgacctccacgaaccagcacgatgctgtgttcctgcaagttgtgaccctctccggggatgtaggcattgacttctttggaattcgtcagacgcacacgcgccaccttacgcatagccgaattcggcttcttgggcgtagtcgtataaacgcgcacacaaacgccgcgacgctgcgggcacgaattcaatgccggcgatttgctcttatccgcgaaagattcacgaccctttctaaccaactgttgaattgtaggcatttcttctttctttaaaactatgattataattatctctttcctaatctattacactgccaactatacgagcagtggcgcaaaggtacatatattttcccaatccacaacagtccccgcagcttttttttcacggcaacgctctaatactcaatagtatcaaccgacatctataggccgaactgttccgcccgagcgagagatccgaaaaggtggatgcgcaccgaaaagaaagagaatacaaaacagcccgaaaaagtgagatacagcgtgcagccacagaaaagaaacgcactgcatatattcacagaaaagaaacgcactgcatatattaatgtacgcgcgcgagagatgctgagggcagcactattcagtccaaagagagaaaacggaacggaaaaggacaaccatccagcaaaccgtttacgcgccacaattttctgtttcgatgctccgcaaaacgtggcgcgggaactttttcgttttggttcgggaagtaaaaaattctcgcgccacgaggaaaaaattctcataagacttttcccgaaaacacgcgccgcaatcagagcaattatggttcgagaaaatcagatcggaatatatccgcccaagagcgagaggggtagctatgaagctgtaccgacagcctcgatcgccacaataactaccgcaatcagcgaagccgtcagagccaagaagagcaagcaatagaccacaacgaggattgtccgccagaagctccgccaccaagagcagaggaatagctgcttgtagtcccagcaaaacaaaaggaataggagcaatgcaggtagcccgtatagcgaccccacccgggcatcgctgtagaaaggtagggcgagaacgttcagcaacaatagctggcaggctatgtacgcctgagcgataatgtgctccgtcagattatatgctccggctcctttttgtcggaaagccgctttcgtactcacggcgagaatgggaagaatactgatgatcctgacagccttgttgccttgaaaccacttcatcagcaggctccatattcttgaaaagaaagggagggacttcaacctatttttctgctcggtgacaaacctcatttgtttgtaaaaaaaggctcttctccccgtgtgtcgctcggcaatcatttctccgctatcgctgccgactgccttattctccttttgcaaggaggatatttctttttgatccatccgatactcttgacgcgtaagctcttcgccaatgggctttttctgcaagggatcaggtccgatcagttgtgcaaagatgatgtacagagaggccagcacgaaaagggcctgaaagggacggaagtagacaaccctcttgccaccgataaagtcccgtatcaaataacccgggcggtagagcagctccacgatagtacgcccgaaaccgctgtcgatattggtgaagccgcctatcacatttcggatcatctgccggaagtgataccgtccggtgcgagaggtttgtccgcagcggttgcagaaattgcccgtatatccatctccgcagttttggcatatatgtatgtatgggtctgcaggtggagtcgctctgccacgcatcagtctcaactcgaatgcgcggattcgtacccgaaggggaaagagaagtgattgcaaccgctgatcgatctttcttggcagtagtctgcgcttccgtaggattgcccaaaaagccagcccggtaatggcagatattccccattgtcccgaagtggccaaatcttctattgccaaccataggagcgatgcaagcatgaggatctgcaatgagttggccatttttctctccgaatgcccatgctccccgtttttctgtttcttcgaagtactatcgcgcgaaccttccatttttttcttcgttttgctactcgtttgcattatctgaatttcacttgcttgcgtacaaatatagttatgacaaatggagggcgtagcacactcggttcggtcgcttacgggtgagctgccc

SEQ ID NO: 503 - DNA (genomic), 554 bp, PORYPHYROMONAS GINGIVALIS; double-stranded, circular
  misc_feature 1...554
  hypothetical: NO
  anti-sense: UNKNOWN
gtaagaacgggatacagggtcgaaatagggtatgcttatggcgggtatggtaaactttcccgtctgacggggtaccacataatactcgatcgtacgctgtccatcggcacccgaagtacttatgcgaaggctgctctcggccttggagtcgtattgttcgaagctgtcgggaaatctcactttgggatctcccatcaacttgatatttccgcttccgttaattacgagcttgagtgtaagggcttcgttngttttggcctgacggtcattgaaagaggctgagatccgataattaccaacagcaccatcgaatccttggggtttcggttcaggcaagggagcgacatctattgtgaccggattggtggtcagagtcctccgcacattctcatacggntggagtacaaagaagtcatctatgtcgtctatctcccgtcggaccgntactacgacacgaaagttgcccgatggaatagtcagcttaccgcttttttgaggaaagagcaacgactgcttgagaacggttgtctgatagttccgtccttcataactct

SEQ ID NO: 504 - DNA (genomic), 3295 bp, PORYPHYROMONAS GINGIVALIS; double-stranded, circular
  misc_feature 1...3295
  hypothetical: NO
  anti-sense: UNKNOWN
ggataggacgggacgatagcacgaatgtattccgtgctccgctgcacaagcttatgccacatgtngataccactaaggcctctatcctgctcgatcaccagccgcacaagctcgacagcgtggcgatgaccggtgtggacttggctctgtacgggcacacgcacaacggacagatctggccgtttacgattttgacccaactggcttttgaaaaatcatggggctatcttcgcaaagggcatacgcagttctatgtcagttcaggagtaggagcggccggaccggctattcgtgttttcacggagagtgagatcgtcattctgaatgttcggtttgcctccgaaaacaaaccggttcattagccttccgaaaaacgaacaaatacaattaaccccaagaaccaccacgatggcaggttcttggggttagtgtttttttagcgatctatatcacggagttcttgccgcaacatccttacgccttccgtggcaggagcatggatataccgaatgtcttgccgggaggtgctgcgcacaggctttggatcgatcagatagatggggcagttgcgaggagcataattcaacagtccggcagccggataaacgttgagagaggtgccgatgacaacgagaatgtctgcctgtgttacctcttcgatggccggctctatcatcggaacagcttctccaaaccacacaataaacggccgtagctgacagccgtcgggtgccagatctcctacatgcagatcgggattggtcgggtctacgggatagagcacactgtctgtggccacagatctgttcttcatcaactctccgtgcagatgaatgacgtgtgtgctgcctgctctctcgtgcagatcatccacattctgcgtgatgattcttacatcatactccttctccatttccgccaaaccaatatggcctgcattcggtttgcaaccggcatagtcgcgtcggcgtgcattgtagaacttgagaacgagggcaggattgcgcctaaacccatcgatagaggccacatcctcgacgggataattctcccacaatccgttggcatcacgaaaagtcgatatgccgctttcggcactcatgcctgcgccactcaagacgacgagtcttttcttattcatgtcgtatccttcgtttaggggtttattgacaaagataaagagaagtccccgtatatttgtctgcaattatcagatagttatgactaccaaggggaggaataccaccgtcgatgtcctgcgagttctggcaggattgatggtaatcggcatccatacttcgggagaatacgttctcgaaggagtggctgagggtgcaaactttatagccggtctatgctgggaggcggtcgtgcagccggccgttcctatattcgtcattatcagcggggcttttgtcttgggacgcaatgagacgtggggagatttctatcggaaacgaataccgcgactgctggtactactcgctttttggcttccgttctattggctgtggctgtggctcaagggcgatgatataggttcctatcttgccggcttttggcagggacgctcattcgttcatctgtggtatgtggtgatgctgctgggactttatgcagtcgttcctctgctcaacgaaataattcgcaggtgcgaagccgatggagagaaggctgctcgtaaacgactttggactctctctaccatattgctactgctggggatattgtccaacacctacgattacatactcggttacaaccgctttttcccttttctttggccggattatttgggatatttccttgtgggttataccctgaagagccatgctccgcagcgttctttaccggctctttccttgtacggactctctacgatttctcttttcttcgcaagtcggtacgctttcgagcacggcgaagggctatacttctaccgtaatctctctcctttgattgttctttctgctatcagtctcttcgcgttcttcgtttcttggggaggatgtggaggaaaattggcgcggatcgggaaaatgcagggggatattttaggaatctacttagtacacatcgctgtgctgaacgtggtgacaaaaatacttgtactgaccacccccagcctgatgcaatgcgcatggctcaacataccgatccgtgtaggattggttttcttcgtttcttggggagttgtgcggctgatgaagcggttgccgatatgccgctatttggtctagatcagtccgataccggttctattgtacccgtttcttcgacctctctatatcgttcgcccgtttcaggacagacggccatccccttgtcatcgaacgacaagcggtgaccggcgcggcttacccaaccgatccggcgagcaggattgcccactaccaaggcatagggcggtacatccctaatcaccacggttcctgcacctaccatggcataagcccctatcgtaataccacaaagaatagtggcattggctccgatggagacgccttcgtgcaaatgagtggggcggtattcggattttctttcaataaaggcgcgaggattgatcacgttggtaaatacacaactcggtccgaggaatacgtaatcttcgcatatgacaccactatacagagaaacgttgttctgcaccttacagcctcgccccagtcgtacctccggcattataacgacattctgcccgatgttgcaattctctccgacctcggctccgcacatcaagtgagagaagtgccatacgcgtgtaccctgaccaagcacacaaccgtcttctactatcgctgtgggatggatcataaagacctgctatcaattggcgatcaactgttcggcacgttctaccgatgaacggaatgaggcattcatctccatctcgttcgtcacacagcgacagccgtggagtacggtggcatggttacgtcctcccatcagttcgccgatagccgacaaggactgagccgtgtgttttttggagaggaacatgaccacctgacgagcctgtacgatatcctgcttccgactcttgcttttcatctgctctatctgcacctgaaatacttctgcttgacttgcctgctggatgcactcgatggtgacttcctttttcttcccagtcttgacaagctttggcggacaatcccgtttggccaaaggtcaggtcgatttccttacctacaaccaccgaatttgtgatcaaggatacgagggtgccttccagttcacgaacattgtcgcagacattttcggcgataaagttcagcaccgattcgtccagccg

SEQ ID NO: 505 - DNA (genomic), 533 bp, PORYPHYROMONAS GINGIVALIS; double-stranded, circular
  misc_feature 1...533
  hypothetical: NO
  anti-sense: UNKNOWN
gggcaaacaccattagcagaactaatgagattgtccggcttggtcgttggcttcactacgtaggtctccttgtcgaagtttacgtatctgaacttgaactcactcaaactaccattgacaattatcggcacaatctgaaatttctcactcagcgagatattcagctccaccttggcaatggcacgcacaaggggcacattgtccaaaagacgattggccaagaagtcgtgtgtcttgtttccggacatcaggaaaggagaggctatatcggtcgaccacggcattgcagtcgtcctctttacagtctgcaaatcgctttcgttagcgacagcatcaagagccgttttaaccgcattatcaacattggctacgacatatactttgcgctctccggcctcggattgtgtcatatccaacttcaccttcatatcgtcaggaagccaggtccctccggtgaaagtgttaccggtaatataagtatttcgccggattcgcccctgactgatcgaacaacaaggagggtaaagattggg

SEQ ID NO: 506 - DNA (genomic), 2818 bp, PORYPHYROMONAS GINGIVALIS; double-stranded, circular
  misc_feature 1...2818
  hypothetical: NO
  anti-sense: UNKNOWN
ggtagtactctgcctttccaaggacctgccttttgcacaggctcgcttctgtggtgccgaaggtctggacaaggttatcaccgtttcagctttccgctgcgactgctttgagaagggttatggtctgctgatgaccgatggccctttgaaaggtctcttggctcgtgccgtcgttgtagtggacgaaaacggtaagatcatttacgaagagcttgttcccgagatcactcaagagccgaattatgaagctgctatcgctgcactgaagtaattccgttcaaataccaaatattttcggggctgtgttcaatctcattggcacagccccgattccattttcagtatctaccaaacaaacgtttcgatgcccttctctcttatcataaaagaaaaaggttggaggaatggctgtaaattgtgaagagagaggtcggaaggagcatgaaatcaatgggtcggaaagcctttagtatttggtcttatccgttttttctgtccaaagacgaaaagaatggagtgcttcatcctgcagtatcgggatgatcggagtagagcggttatccataggacgagccagctcttgatagataaaatcgtcatcgaatcctatatcggcagcatcctgccgattgttgccatagaaaatccgatctatgcgtgcccaatagatggctccgaggcacatcggacacggctcgcatgaagtataaatggtacatcccgaaagatcgaaagtgccgagccgcttacaagccatacgaatacaattcacttctgcatgcgctgtggggtcattgtcgagggtcacacgattgctcgtcgctgcaatgatctctccatcttttactatcacagcaccaaaaggcccccctccattggcaacgctttcgtcggccaatcggatcgcttcgcgcatcatctccttatcctgttccgtatgattcattgtattgtgcatgttcaattgtttgcttccgacaggttgtcggcttatgcttcgggagtagatacagtttcattcagagtgattgccgtaggagtgatcctgatcaaacggcgacgatagagcattccgacagccattttgaacgttttcttgctcataccggtatgttgcataatttcctcgggcgaactcttatccccgatgggaagccgaccgcctcttctttggagcatgtgtagcagtcgttcgctctcggagtcaatacggtcatagcctatcggtttgagcgagaggtcgattttaccatcgtcacggaggcgaatcacgaaagctttcacttgtgccccgatagccaaaggcatcggtagcgtatcggaatagatcatcccccaatgggtatgatccacgatcatgcgataacccggatcgattcgttcgtaaaccagtgccgacaccttgtccccaggggagtaggatgggggaatgttgcccaaatgtttggacaatttcgccgagccaacgatcttaccgctcacatgatcgatataagcatagacgaaatagcgtccgccttctcgaatgagctgcgtctgttctcgaaaaggaacgaagagatccttgtgtatgccccattccatatacgccccactatctgtgacggagacggcatgcagcagagccacctgtcccacttcgacaagcggccgcatggtggtggcgatgagtctgccttcattgtcatgatagacgaatacctccacttccataccaggtgcagcatctgaggggaggtagcgattgggcaacaaaatatccgtatcgcctccatcgagatatgccccaatggatacgatacggtcgatggtcagacgacctatgcgtccgagctggtatttgctccgcttcatcctccgggattactcaagcgtaactgacgattcgtcgcgcaggacgggttgcaccaaaatagattcgggcataccatcgcgctgcacctgaaagacgcacgaagtaatctgctggtcgtttacgtacgaacggaagaagaaaagataggcaaaagccggcttgtatttgggctgagccatcatgcgtgcaatcttctcgtagttcttgggtgaccaataacgacacccggccaaaccattggcatcggtgaaggtgtcttcctcagtacggtacttcatgctctttttgatgaactctttgtaagcagaggagtactcttcggatccggacaaagcaggaataccgttgatactgatgatacggtctccggctttcagccctgcctttgctgccggagagtcggggtcgactgctgccacgagcgaaaggtcgttggcctgatagtacagccccgtatagaagtaacgctgactccgcagacggaacgtcgggttctcacgatagcgaataaacgggaactccatcatcatcaaaggcacgttgtatcgcgcatattctgccaactccaaaggtgtggaaaggaaatcattcgactcgcattgccagaaaatttggagattgttcctggcattgatcagccgtacgccgagctggattacataaggagcattgatctcctgtgtgccggccggcataatggggatcgatatcatcctcttgtcacgcggagaatactgccaagaattatgaggggcggaactattgaatgaggtaaagagcttgttgttgtcgaacagataataacaatcgacgattacatcgggattgttcagcgtctccttcattcccatggcactcagatatttgcccacttctttgtagacagctatatcgatctcctcgttgtcgggcgaagaagctgcgaaagagtatgtacgcagattggtaaagtccgctttggtc

SEQ ID NO: 507 - DNA (genomic), 585 bp, PORYPHYROMONAS GINGIVALIS; double-stranded, circular
  misc_feature 1...585
  hypothetical: NO
  anti-sense: UNKNOWN
nagttgctgtgcgcaataatgagggtaggatggtgctcatcaatggcaacgagatttgttcgctgcttatctattattccatcatgcgtcgcaaggaattgggcgatttgcatcctgatgattatatcgtcaagacgattgtgactacggaattgatccgcgatatagcgaagaaagagcatgtgagcatgttcgattgctacaccggtttcaaatggatagcagccgtaataagagagaatgaaggtcgtcgccgctatataggaggtggagaggagagttatggatttttgtggggaagactttattcgagacaagagttcggtatctgcttgtgcactcttctgtgaaatggcagcttgggctttggatcgaggcatgagtgtctatcgactcatccgcagcatctatttggaatacggtctttactacgaaaagggacttagtgtgntgcgtaaaggcaaatccggagcagaagagatagaagccatgatgagaaattatcgtgagtatgcacctgtagaactcggagctcgcctgtgcangaaatatggactatgcttctctcgaaggaaaagattcaca

SEQ ID NO: 508 - DNA (genomic), 3030 bp, PORYPHYROMONAS GINGIVALIS; double-stranded, circular
  misc_feature 1...3030
  hypothetical: NO
  anti-sense: UNKNOWN
cgagggaaaacagatccaacaccttacgaatcagcaatcggatatgccggcccgtaccgttagctgtcttcctcataccctttgcggaggaggcgtgatgcctccctcatcacctgttcgtattcgaatcctcgtcccacagcccagcgcaccaagcggtgcagacgaccgcgatcgtccgtatcctttatgcttcgaagtttgcgctccaagagacgcggcaggttatcctctatcttatcttctccctcctccaaatccaataaggtcgaaccgatgatcgaatccggaatatgccgtttgaccagttccaaagcgatgcgcttgggaccccagccattgaatcggtatttgtcacgagcataagcacgggcaaaacgatcctcatcaatgaaccgatcttccacaagccgctgcagcagccgctctatcattagctcgtctgtccctgcctgtcgcagtttggctgccacttctgatctgcaatgttccgtacgggcgcagtaggcttgcatccgattcagtagttcctcctctgtcttcatgctttgttagcgggtaaatattttgccgagagaaaacggctcttgccggagaggtccgtgtgcaatcggacttcacaccatcccactttggccgaaaatacttcgcatgtggcttcggccagcagcggattcagctccacataaagccgtccgccggagcgtagtttaccgctgccggaaaggttggcaatggctttgtagaaaaggagaggatcctcctcgggcgcaaagagagccaaggccggttcatgtcccagcacatgatacgccatatcggcactttccgcaggcatgatgtacggaggattgctgacgataatgtccacgggggggagtacgtcccaacgattatcgggagaaagaatatcgccctcgaagaaaaatatccggtcgtcttctccgacattggtacgagccgtagctaaagcatcgggtgaaatatccatcgcccatactttggctcgaagttctcgtgccaatgtgatggccagacatccgctgcccgtgccgacatcgagcagacaaagcgaagccgccgcaggcctctcctttcgcaggatcaactccaccagttcctccgtctcaggacggggaatcagcacagaaggatttaccgcaaattcatacccgaagaaaggcgcatgtcccacggcatactgtagcggaattcctgtcttcatacgatccagatagcgagatagagcttgcgatgcttcggtcgataaaagcgtatctttgtctgcaagcaaaagtgcggagcggcttaggccggttgcttcggtcagtagccctcgcatgatgctgcgcaattcatccttgtcgtatcgaccgttcagtgtcgattcgattcgctgttgagcttcgttaagcgtaatcatcagaaacaaaattagcaattaggtatgactcccgatcctctgtatatgcgccgtgccatcgaattagcacagaatgccgaagggttcacctctcccaatccgcttgtcggagcagtccttgtggctcatgggcgtatcatcggtgagggctaccaccactgtgccggcatgccccatgccgaagtcatcgccataaactctgtgcgagacagggctttgctcagagaaagtaccctctatgtcagtctggagccttgctctcattatggcaaaacgcctccctgtgccgagctgatccttcgggagggcatccctcatgaagtggtggccatgctcgatcctttcccatccgtttcaggaagaggcatcaagatgttgcgtgacgcaggcgtatcggtccaagtgggactacttgcagaggaagccgaggagctgaatcggcatttcctcacagcccaacggcaacaccgtccctatgtcacactcaaatgggcagagagtagcgacggattcattgacgcactgcncgacnatgcctccacccctcctgtcaggctgagtacacctctgaccacacgctttgtgcaccatagacgaatgatacacgatgccatattggtggggttccgtaccgctcttttggacaatccctctctgacggttcggcattggtacggccgaaatccgctacgtgtggtcacagatcgccatctggctctcccacgccacctcaccctcttcgatggcagtgtgcccacactggtctttaccgaaaaagaacaaccctccggctatccctccgctgtctctttcgttcggatcgatccctcccgccctcccgtggagcagatgctggccgaactgcacgctcgcggcatacagtcgctgttagtggagggaggtgcctgtatactccgatctttcatagacagcggtctgtacgatgatgtacgtatcgaacacagcaccattatcttaaacgagggagttcgtgctcctcaccttccctcttactgaattttacgcactgcaatcgatggaattgcggcgcgtattctgcgagatttaggcgcgtaaattacttcgtttacgcgcgagaaatttttcattcccgaaccaaaacgaaaaaaatcccgcgccacgttttctcgccccatgccccatgcgtttttggtctgagaactgctatacgacggcagagccgtcggatgatggaaacagactgcatgcagtcaaatcacagagtctcttacactacgtaatctccgtaaagtcccaatcgggtcaaagacctgttttcttcataggactttccgcaaatgtgcaaggcctttgcttttagggtattacccccacgcagcatcgagtgttttaggaggaaaagtccgctttgtttcgtacttttgttccacaaaatcgatcataaatagaagaaccccttatcattatgtacagaacaaatacctgtggcgagttgcgcctttctcatctgcaacaaaccgttaccctctgcggttgggtacagcgcgtgcgccgcatgggcggcatgacctttgtagatctgcgccaccgttacggtactacgcagttggttttcaacccgtgat

SEQ ID NO: 509 - DNA (genomic), 737 bp, PORYPHYROMONAS GINGIVALIS; double-stranded, circular
  misc_feature 1...737
  hypothetical: NO
  anti-sense: UNKNOWN
cccaatccgtcgctccgttaagaatagagttgatctgcccatcggtagtaacctgtacttccgtgtcgaaatcgaatttcttgataaagatgttattgtctctgacgaacgctaccatccggccatcggggctgaatgtagggatcatcactttgccgacatgctcgctcagtggttttaccaaattgcggcgaacatcatagtcgtagacggcagcacgatacgaatgccgatagatgctctccatatccgtaaagagcaaaatatgatgtccggtactgcttacctcgtagttctgtatttgtttaaacgggcattcgcgtgctcgttcgacactgaagagcgtatctaccgccttgccggaggcataattgtagcgaatgatagccgttcgctcacggttcatctccgtatagtgttctccatccggcatggagcgtattccactccctgcactgcgagcataaaacattccgctcgtgatttctttcaaatctacgggtttgttccccgtctgagccatggcacacatggttacgatgccaagtagcagaattattaccggtcttttcataagaaagtgtattgtatcttcttttaagtggtttattgcttagcgtttcaatgcacgatccatctctcggcgatcatctcgctctttgatggatgcacgtttgtcataattgntttttccctcgtgccaatccgatttgcagcttggccaatccctttcatgg

SEQ ID NO: 510 - DNA (genomic), 7319 bp, PORYPHYROMONAS GINGIVALIS; double-stranded, circular
  misc_feature 1...7319
  hypothetical: NO
  anti-sense: UNKNOWN
gattttcaacggtttgctcttcggcgacagcctgatggattcctcttcgccggagaatgccatggaaggctatgcacagatgctgggagaagactatcgctctaacaatgccgaagccaatctgcaagggcttccttctgaccttttggactatatctacaagcaggaaaataccatcgcttattgcgatacgggattgatctccacgcgcatcaatacatatacttacgaaggcggtgcacatacggagaatacagtccggtttgccaacatccttcgcaccaccggcaaggtgctcgaagagcgagatatattcaagatcgactatgcggaaaggctgtccgcactcatcataggacaattggtgcacgatttcggcaagaccacacctgccgaattggatgcaataggtttcttcaacgcagaagaaatacagcccaatggcaattttatgatcgatgacaaaggtctcacatactgtttcaatgagtatcagatagctgcttatgccagaggtgctgtctatgtccgtctcggatatgacgtattggctcctttgctaagggatgattccccactaaagcgttacttgccgtagccccctccttttgcttcgaccgatatgaccaatatgcaggagatacccgaaaagccgctgtcccaaccggcaggtaccgagatcatcgagaaatacttcccccacttgtccgaacggcaacgcgaacaattcgagcaaatgggagggctgtacacgcattggaatgccctcatcaatgtcatttcccgaaaggatatagacaatttgtatctgcaccatgtgttgcattctttggggatagctcgcatgctgaacttcaaacccggcacaagtgtattggatttgggtacgggtggaggtttccccggtattccactggcgattttgttccctcaagtctctttcctgctggtggacagcatcggcaaaaaggtgaaagtggcttcggccgtagctgaagcattggggcttgacaatgtgcgcactatgcactgtcgggcagaaagcataggtgagaaattcgacttcatagtcagccgtgcagtaatgaagctgagcgaactggccaagatctgcaggaaactcatccggcgtgaagatcagcaaaatgcgctcccgaacgggcttatctgtctcaagggtggcgagcttcagcacgagatactgccattccggaacaaggcaatgacagaggagctatggccgaccttcgaagaagagtatttcaaaacaaaaaaagtggtctacttacctctatgacaacgacagaagtaaagatgttcaccttcaattcggtggcagaaaatacatatatcctttacgactccacgggcgaagctgcacttatcgactgcggctgtatggatgggagcgaagagcagcagctactccgcttcgttcaggaacagcaactgacagtaaagctcctgctcaatacacatttgcacttcgaccatgcctggggcaacggctttgcagctaaaaccttcggtctgcctgtgctcacgcatcgggctgaagtggaagaaatgccttctccgtccaagcaactggctgccttcggcatgttcggtacgatggacgaaccgcccatacaatacattgctccgggcgacgttcttcaattgggagagagtatcatcaaggtgcttttcgtcccggggcactcgcccggtcatctggcattctattgcccgcaggcccaagctgtatttaccggcgatgcgctctttgctggcgatatgggccggaccgacttatggggcggcagctacgaactcctgaaaaagagcattcgtacggaacttctcccccttcccgacgatacggtagtctaccccggacacgggcctacttctacgatagcttacgaacgaactaataacccttttctcgattagaataatgaatactaacaaattcgaaaaccgccatattggtattgccgagcgcgacctctccgtcatgctccggaccataggcgtagagtcaatggatcagctgatccgcgaaacgatccccggcgacattctgctgcccgagcctctcgatttgcccgaagccatgaccgagcgcgaactgctcgaacatttcatggaactgggatccaagaacaagatcttcacctcctacatcggacaaggctggtatgatacggtcacgccggctcccatccagcgcaacgtattggagaatcctgcgtggtacacctcctatacgccttatcaggcggaagtatcacaggggcgtctggaggctctcttcaatttccagacggtgatcaccgaactgacggggctgcccttgacgaactgctcgctcctcgacgaagccactgccggtgccgaagctgcacgtatgttcttcgatacccgttcgcgcacacaaatcaaggctggtgccaacgttctcttcgtggacaagaaggtattccgctctacgatcgaagtgatccgcacccgtatcatacctcagggtatgcagatcgtggtggatgactacaagacattcagcttcacacccgaagtatttgctgccatcgtacagttccccgatgcagaaggatctgtcaatgattataaatcattcatcgaagcggctcatgctgccaatgccaaagtagccgtagtagccgacctcttgagtatgaccatcctgactcctccgggagaatggggggccgatatcgtattcggatcggcacagcgtttcggtattcccatgtattacggcggcccgtcagcaggatatttggctacgagtatggactacaaacgcaacatccccggccgtattatcggtatgtccaaagatgcttacggacgtccggcttatcgtctggcattgcaaacgcgcgaacagcacatcaaacgagagaaagccacatcgaatatctgtaccgcacaagctttgttggctacgatgagcagcttctatgccgtgtatcacggtgccgatggcttgcgccacatagccggcagggtacatgcttatgcaggatttatcagcgagaagctctccggactcggttataagctgacaaataaggactttttcgacacgcttcgtgtggagctgccggccggtgtcacagcagacaaagtacgcgaactggccgaagaatgcagcgtaaacttcttctaccctgccgatggcagcatcctgatcagtttggacgagactacactgccgtccgacctcggtgttctgctctatatcttctcatccgttttgggcaaagaggagacaatctcggaggacattgccatcgacaaacggtatttcgacggtgcctttgcccgtacctcgaacttcctggactacgacgtattcaacaactaccacaccgagacggagctgatgcgctacatcaaacgcctcgaacgcaaggacatttcactggcacactccatgattccgctgggttcttgtacgatgaagctgaatgccgcatccgagctgttcaacctctcgatgccgcagttcaatgccattcacccgtatgctccgaaagaccagacggaaggctacaacgagatgctcgaaagcctcgaacgttacttggccgttatcaccggtttcgatgccacttcgctccaacctaactccggtgcagcaggcgaatacaccggattgctcactattcgcggctatctgaacagcatcggacagggacaccgccatctggttatcctgccggcttctgcccacggtaccaatccggccagtgccatccagtgcggatacgatacggtgacggtagcttgcgacgagcgaggcaacgtagatatggaggacttcatggccaagaccgaacagcacaaggacgaaatcgctgccatgatgattacctacccgagtacgcacggtatcttcgagacgaacattatcgatctttgccatcgcatccacgagtgtggaggtcaggtgtatatggacggtgccaacatgaacgctcaggtaggactgaccagtccgggcttcatcggagcagacgtgtgccatttgaatctgcacaagacctttgctatcccccacggaggtggaggtccgggtgtaggtcctatctgtgtggccaagcacttgactccattcctgccatcgcacccgctgcgtgaggactacaacggcttggaagtatccgctgctccatacggaagtgcaggggtaacgactatcacctatgcttacattcgtctgatgggatacgaaggtctgcgcagagctacgaaaatcgccatcctgaactccaactacatggctaaccgtctgaaggatactttcggtatcgtctatacgggagccacgggtcgcataggtcatgagctgatcctcgaatgtcgcaagatcaaagaaagcggtatcgacgagaacgatatagccaagcgtctgatggacttcggctatcacgctccgacgctctctttccccgtacatggcactctgatgatagagccgacagagagcgagagcctggccgagctggatcgtttcatcgatgtgatgaactgtatctgggaagagatacaggaagtggctcgtggcgaacaggaagctaccgacaacgtattgaagaatgctccgcatcctcaatacgaggtgacggctaacgactggtcgcatccgtactctcgcgaaaaggcagcttatccgctggaatacctgcgtgagaataagttctggctcaacgtagcccgtatcgacaacggctatggcgaccgcaatttggttccgagcctctgcagcgcatgtgaggttttcaacaatcaatagaaaacttcaccgatacagataataaacgaaagcgaaccccgagagtcaaataaaaactctcggggtttactttttcaaaaaacaggatacaaagcgtaaaaatatgatcttatcctgttgtggaaaattcccccaaaaaggaaaataaagaatagtataactttgcccggcataaaatggttatgtaaaaactgtttttgactacaatgaagataagatatctcctctccatattcctgttctgttgctttatgggagctaccggtgcgatggccacgaagcctgtgcttccactgtcccaactgcaaaatcctccgttagccgacacagacagcctcccgacatctccgatagtctccggccgcctgctgatgaactatctgcaactaccgctcgtagccgaaaattcttccggtccgttagcagcaggaatgtggcaaatcaccatgcctgagataccctcgcgtttgcaacaagtccgccggacagaacctcttcccgtaccggatctgagcgacatgattgcagaagtggaattggcacgcagagtcctgaccgaactgcaatatcgccgattggatcttttcacatatagccgtacggaattggagcctttcgcaccggattattcctatataaaaccacaagacattcagctcatcgatgggggagccttatccgacagaataatcatgccggaaaaaatccgcggaatcgaactcaaaccccgctactggtttttcagcatggagacaatgctgcagttctcacagaactacatttccgaaaactggtacaaaggaggatcgagcaacctgaatatcatgttcggcaatctgatcgtccgccaatatcgcaataagaagattcgctggaaaaatgagttggaaaacaaactaagtgtcttcaatgcagccaaagacacggtcaatcgctatcgagtggccgaggatttgctccgcctgcgttccaacttcggctataaggctttcaagcagtggtactactctttcgatgcggaaatgcgtacacagctatttaccaatcgagctgaaaacagcctaaaaagcaatctgcattccttgctccgatgatcttcaattccggtatcggtatgaagtacgactggatacaaaaagcaaaaaagtctatggcaagtccgccaaactgggactgttcctatctcccctctcgtacatcctcaaatggtcgatcagagcgatatagacttggctcgccacggctttcccgaaggaaagaccatcgtacacgaattgggttcggccataaaagccgaactcgtatggaacttcgatagtcgtctgagttggcagtcgcgcctgtatgccaataccacatacgataatacggtggcagaatttgaaaatgccctcaacctgtcgctctccaaactgctgagtacccgtatatatctatacctgcgctatgacgacagcgtatcgctgccggacggtaaaggaacgtattggcaggtgaacgaattggtgagtataggtctctacttccatttgtaaggagctttttcccctcttatgggagcatatccttcggagtattgaccagaaagagtcgctccgaagctcgggtaactgccgtatacagccaacgacagagttgctcgtcatgaggcagatagctgagcatacccatatctacatagacatgtttccactgtcctccctgcgctttgtggcaggtgatggcataggcatactttacttccaaggccgaaaagaaagcatcctctttgatcgctttgcgtctggccgggatacttgccatagaattatagtcctcaagcaactgcatcatacagtttttgtctttgtgcatgagtcaagccggctgtttcggctgtcagtccatcgaggagcaatcttgcttctatctcgcgcccttgctccacaaggctgatggtagcatcggcaaatctaaatccgtacagctcgtatcgtttgcccaaccgcaaaatctccacgatctctccattggcaacgaagtctgtcttgtctcgcctgtcacaataacgatagttattccgcgtcaccaccaatcgatcgccccgaatcaactcttcttcgtagtacaatacctgactgcggatgcccagattataggccaaagcacgtttattggaatagctgacaataatggtctcgtccatgcctacagtccgaaacgaagcatccagtgcttctatcagttcagtgccggaaatagccgacacatctcccgaatcccttatgttcaacttgattttttccgaaataccattggaaagtaaacggcgtaggctcgtggccagagagagaatggcggattctttctgctgacgtaccacctcggtcagtgtacattcatgtatacgcaatccgtaggaagtttccattaccccggcatccaatgccggactcaccacactgccgaccggcggaagctgtgccatatctccggccagaatcagacggcaaccatccgtttcgttcac

SEQ ID NO: 511 - DNA (genomic), 616 bp, PORYPHYROMONAS GINGIVALIS; double-stranded, circular
  misc_feature 1...616
  hypothetical: NO
  anti-sense: UNKNOWN
ggaacttcgtctcctgatcgatagcggacgttatgacagggctttgcccatagcccaacagttggtggccaaaaatccaaagcatgccgataataactatatgctagggcttnttctgtacanggctgaacgctacgaagaagctattgctccccttcgggtggccgtaagccggcggagtgatgcctatgagatgttggcggatgcttatgccaaagagtatttcttctccgaagctcttgctgcactggaaaaacagaaggttactcttgtgaagaaaaaacaggaaacagtctccatagatgccggaatagaccgtatgcgacgagctgtgcgcttactggacagagccgaatgggtggaggtgatagacagcgtacggacgaataaagccgatctcctgtcggcctacaatctcatagccgataacggtcggctcgaatgggtgaaaggaaaccaaggggaggcgacttcttttgtcaatgggcgcggcgaccatgccatcatgacggagaaaggtgaggatggagtttncagcctgcatgaagnnnnncggatcggtggcaaatggggcaatgcgatccccctcgaaaaactcaattcccgattcaatgaa

SEQ ID NO: 512 - DNA (genomic), 608 bp, PORYPHYROMONAS GINGIVALIS; double-stranded, circular
  misc_feature 1...608
  hypothetical: NO
  anti-sense: UNKNOWN
acagagggagttcggaaccctctccttcgttctccatttgcatcttggccatgagagcatataagagagtttgagctatggccgtcggatgttttttgctttttcctgctatcgggtgttggaacataagatcccatgagccaagctctgtggtggtatctccacttttgtagtccactatgcgccgacattcctcattcaactcatcaatgcggtctatgattccgtgtaaccgaacccggctaccattgctaagggagaagctgcctttgactctgcgctccgagtctatgtagcgaaagggagccaatgatttgtnatgctccaagatccgccgtacatacttctctatcatgatgcaataaagatgattcaatcccgacaaagctccctgtgtattggccgatcggagatattcttccgtgtatgcttgccttactatcctcgcgatagttgcattcttcggatccaaccaccgagataaaatatccgaagaaactatcccaccaccgcaacaaggcttgtagatcaacttcatggaacgatgcaccacggaccgaaatcattggcggccatcagttcatcggaagcattctctctcgtatcct

SEQ ID NO: 513 - DNA (genomic), 9461 bp, PORYPHYROMONAS GINGIVALIS; double-stranded, circular
  misc_feature 1...9461
  hypothetical: NO
  anti-sense: UNKNOWN
ttgcaaaaggagctattcaaaaaaacacgaaccggaaatgctccgattgtggcgcgtattccctgaaaaagtggcgcgagaattttttcgttgtggcgtgagaattttttgcttcccacgccaaaataaaaaagtttacgaaccgcgttttgaggagtagcaaacgggaaaattttggagcctaaaccaattcggttataatagtacatgttcctgatcttcttttctgaaaaggcttgataggattgagggaactgtttcttttttcttttgctttgattcggctgttagtgaacaatgaaaagagaaaaagaagaagcctcttgccgagacaaccgagcggttcttggcagaggcttccttatgtattggtgcaaagtgcacccatggagttcttaataccgagattctacaatatcccagtcaacgatactccaaagatctttgaggtggtcggcacgacgattctggtaagtcagataatatgcgtgctcccatacgtcgaatccgagcaaaggattcaaccctttgcgcacgggattgccggcattgggttccttctcgatggacagtttgccattggcatcggatgcaagccatacccagcccgaaccaaagagggtggtaccggctgtgttgaactcctctttgaacttttcgaatgagccgaattgtttgtcgatagcttcccccagtttgcctttcggtgctcctcccttgcccggacggaactgagtgaaatagagattgtggttgagggtttggccggcattgttgaagataccgccttcgctcttttgtacgatggtattcaagtcagcgttttcaaattccgtgccgatgatgagcttattgaggttgtccacataggtcttcaggtgcttaccgtggtggaattccactgtttctttgctgataacaggagccagtgcatcgaccgcataaggcagggaaatgagttcgtgagtcataacgtctgatttttattgtaattaagtcttttaataatttgtatcggagcagtgtaaaaccgacaccgacaattttttaatcattataagaacatgatgaacggaaaaaggttcgaatcttggtcgtaaaaaccgattcattccatgacgaaaagatagttgctctcatccgaaagctccggccggaagataaaaccttcgggcgaaaagagttgcatctcttccacatggcggcatcggcgggtgaggaggtgggctgtcatcagtccgcgtgccattttggtatagatcacgatctgtttgagacctccatcgggctgtggtactttgaagaggggtgtcactacccgtacggcttgttctactcgtttccagtcgaatagcattttcatttcttcactggccagaaaacatagctcaccacccttttctcgtaccttttcgatcagaaaatccgtaagatacggtcgccagaagttgaatacttcatcttcgacgggtgcccccagatgggcaaatccttccatcctgtatggacgaatcatgtcactcggtcgcaaaagaccgtagaggaacgaggtgataagaagatgttcggaggcatagagccaatcgtcagcattgaaattggcaggagcaagcttcttgaaaaccatacccgtataagccaatgctgccggagcagtgggtgaatcgtcctcgaagaagtgctgccagcgtcggtgattctcttctgccaactttctattgatacggagtagtcgggatagttcctttatatcgcaggaagatgcagctaaagcaatctttgtggtctgctcatcgaagatcgncgaagtggtcgtcaaatgtgatggcaaacgcttcggaataccgatcgtcttggcacatgaaaggagtatgagcataaggcttgatcctgatgacaaaaaagaagaggaagcctccgtctgtatagtgatcggtgggcttcctctctacttcgttttttgttacttggtggttttggacaaaatgtctttcatcagcacatcgaaatactctccgcgggtgagcacaccgtcctgtacggctactacttccacttcgccacgggctgccatcacaccgtcttctctgataatgtcctgcatgaaaatgagtttggggcctttcttgtggcaggtcagacagctacggaagcgatcgccgctacgcaaggactgtttgaacgttatggtcactttgtaaacgaaagcatcaagacctttttcgtgcatttgtccgaaattatctccgaggctttcccagaattcatggcgggtgtgctccatatagcgctgatagttgctgttgtttaccacaccctgcaagtcgcattcatagtctctcaccttcatgtcgagggagaacaggtattctttctctttcatatcattgggttttgtcgggtttgagaggtgataattcgctctcggtccctacatcttattcttctcttttgtcgaaccggtagagcttgtccgacggacgcactttctcctttaccggaatggaaatgcgttgtccctttgtcgccttttccacggtttgcagttcgtatcggatctcttccaccttttggatgatcacacctgtagtagggccggtgatcacaatctcatcgcctatatgcagttcgccggactctatctcgaattcagccacaccgagacggctgaagtatttgatccccttgcctacatatattttctgtcgcgtagctcctgagccgtaacgatgtgtccattcgccgagccgttgtccgaggtagtagccatcccaaaagcctcggttgaataccgtagccaattgttcgtcccaccggcctatggcctcttcatcataggtgccgttgcagtaggcttcgatcgcttctttatagcagcggcagaccgtatagacgtattcggggccacgtgcccttccttctatcttgaatactcgtacgccggcatccatcatcttattgatgaaatgaatagtcttcagatctttcggcgacatgatgtattggttctcaatgtccagttccagaccgctatccttgtccttgacggtgtagcccctcctgcagatctgcgcacaggctcctctgttggcggagctgttgtgttcgtgcaggcttagatagcacttgcccgaaacggccatacacagagcgccgtgagcaaacatctctatacgtacgggatggcctttaggcccacagatattatccctgacgatggtctcgtggattgtacgcacctgatccatattcagctctcttgccaatacgaccacatcggcaaagcgcgaataaaagcgtagggcctccgcgttgctgatattgagctgagtggacagatgcacttctactccgatctggttggcatacatcttcgcagctacgtcggaagctataatggcagatatttgtgccttttgtgccgcatcgatgacggagcgcatgagtgctatgtcctcatcgtatatgacggtattcaccgttaaatagctctttacgcctttatctctgcaaatctcggctattttgtacagatcttctgtggtgaagttgttggcagatcgcgcacgcatattcagtccttcaatcccgaagtaaactgaatctgctcctgccttgatggctgccataagcgattcgtacgaaccgactggagccattatctcgaagtcgtttacattcatttctttcattagtcagaggttcggagtcggagcctccggatgcagccaaggagctacgtccgatagcggcatacgcacaaaatcccgttgccacatttgtgggtggggcagttccagctcaggtgactgtactttcgggtatacggaatgcaatagaatgtctatatctatcggacgatcgtgatagacccctccattgcttttttgtgtacgacccaattccctttcgatggcttgtgtgatgtgcagaatgtcctgtggtttgagttccgatcgcaaagccaccaccgcattgaggaaaggatggggcgattcgaatccccacggctcggtttcatagaaccgagaaagggtgagcagtctgcccaccctcgtttgtagcatctccaatgctgcagacaacaaactgtgtcgatcgcctaagttgctgcccaaagaaagatacactatggccatactcaatcgatgatgagcatggcatcaccataagcaccgaaacgatacttttcttttacagcgaggtcgtatgcactcataatcagttcatgtcctccgaaagcggccgtcatcatcagtagggtagagagcggcatatggaagttcgtaaccaaagcagaaggcagatggaactcgtatggaggaaagatgaagcgattggtccaaccttcgaacggcttgagatgaccgtctgtgctcacagctgtttccaaagcacgaagaatcgaagttcctacggcgcagatcttcttttcttcgtcccatgaacggttgatgtttatgcacgactcctccgtgatatacatctcctcgctatccattttgtgctttgtcagatcttctacatcgatgtcgcgataagctcccaaagcgtggtgtaccgttatgtaagagaaatggcagtccttgatctccagtcgtttcatcagctcgcggctgaaatgaagactggcagcaggtgccaccacggcgccttccactttggcaaatatgctttgatacctctccggatcctctttgttcacgtcccgatcgatgtacttcggcagaggagtctgtcccaattggaaaagcagttccttgaattcgtcatgagagccatcgtacaggaagcgcagcgtacgccctctggaggtagtattgtctatcacctctgccaccagctcttcatcattgccgaaatagagcttattgcctatgcgtattttgcgggccggatccacgaggacatcccacagcttcagtcgttcattcagttcacgcaggaggaaaacttcgatctgagcaccggttttctctttattaccatagagacgggcaggaaaaacacgggtattgttgaagacgaaggtatcacccttgtcgaaatactccagaatgtccttgaaaacgcgatgttcgatttctcctgtacgacgatgtacgaccatcattcgcgattcgtcgcggaacttggtcggctctaatgcaatcagttcctccggaagattgaatttgaacttggataatttcatagcgatatatgttgccgttagttatttttatttgtaggtgtggaagacggattgtcctctttttgttcgaactccggttcataagcaaaaccaagacggtcgaaccattgttccaactcatccatcgaaaggcagtcttcgatacgcgcattgcctactcttgtcctgcgcaatgcctccaaatgtcctcccgattcgagggctgtggcaatgtcacgagccagagcacgtatataagtgcctttgctgcatacgatccgtagcgtgatgaggggtagggcatactccagtagttcgatctcgtcgatctgcaacgtacgggttttcatctccacctctttcccctttcgagccaaatcgtatgcgcgtttcccgttcacgcgaacagcagagaatatgggcggtacctgttctatcgttcccgtgaatcgaggtagtatgtccaggatcgattggcgcgtgatatgttcgtacgggaagaaagcatccggttccgtttccttgtcgaaactcggtgtcgtagcacccagtctgatggcggcaatgtactctttcgtgccggcctgcagcacatcgatttgcttcgtggcacgtcccgtgcacaggatcatcacgcccgatgccaatggatccaatgtgccggcatgccctacgcgcaacttcttgatacccatccgacgacaagcccgatagcggaatttattgaccaagtcgaacgaagtccatgtgagaggtttgtcgaagtatagtacttctccctcgcgcaggtggagcggacgatttatttgtttcatttttccgattcagacagctaaggatacccctgagagcatcaatacgataagcagaccgccaaccaagatacgataatagccgaatgccttgaagccatatcgggtgaggaatccgataaagaacttgatcgcggccagtgctacgatgaaggccacaatattgcccacgaggagcacggtcatgtgttctctgaaaatttctattccgccttccttgtagagtttataggcctttagcagggtggcgccgagcatcgtaggtacagccagaaagaaggaaaactccgcagcagccttacgactcagtttttgttgctgaccgccgactatggtagccatggagcgtgagagtccgggtaggaatatggccagacattggaacaagcctataacgaacgctttggggtatgtgatttctcctctgtccgatgaggcgaagagcttatcgacaaacagcatgaaaataccaccgaggaataatacgacggccactacccagacgctgcccagcattctatctacccaatcttcgaacaggaatcccaaaataacggccggaaccagtgctatcaatagcttccaatagagatcgaagcgactcataaattctttccctttgccttgccctaaagctcgtggagccacgggaaaacaaaagaaacgtttccggtacagcaccagaacggataggatggcaccgaactgtatcatcacggtgaaggctctgacaaaagaagtgctttccacccccattatgccttcggcgataatcatgtgtccggtggaagaaaccggaagaaactcggtcagcccttcgactatggctaaaacgatggcttgtagaatggtcatattatcatgcaggaagagaggtacatccttctcggatcaggcatagaattactcccccacaacgtgcggtttgcggtctgatcggcagaaggaccctcgccggagagttacttgcgattgtcttttttatccggcgataccatgatggcatataccatcagtacgaagccggccatgctcacccacggtgctatctgtatgcgtttggcactgaaaatatccggattgaagcttacttggtcggctgatcctccccctgacatcaatatgaagcccagaatgatgaggatagcggacacccccatcaagataaagttctttttcccgaaaagcatagtatgctgtttgattgtcttagttggtttgtcaatattccttgccttatacgaggtgcattttgcctccatccatgcggatatatttgttcgttgcagcacgtgccgaaaaggcagagatcagtatacctacaagtaacatgccttcggctatggtcaggaggttttccatcgttaagaaggggcgtaaactcctgttgaatgcgtattcatcagttgcatagagggctataccgaggagtagtatggcgagcaaagctgccacgagtccattgagcatactgtagcgaacgaaaggcttacggataaagcgaggcgtggcacccaccagcgtcatggtacggatgctgaatcgcttcgaatagatcaacaaacgggtggtgttgttgatctgtatgtagctgatcagaaggagcaaggctgatagagcgagcagaacgagaccgatacggcgtgtattgcggtgtactatgtcgaacatatccgccctgtattccagattgtccactccattccatgtgcggatggcagagtctatggttttcagactgtccggatgggtgtattgggctttgaggtgaacgcacatttccgcttgcaggggattatagccgagcatcttggccggatcgtcttcgcccaattcttttttcatctcttcgagggcttgatcggcagagatatagctgacatctttgacgaagggtgtggccgctatctgtcgctgtagctcttgtgcctgcgtttcatccatgtcggaggataagagcagattgaaggagaggtcttctctcacggaattgcctattcctctgccgacaaactcaatgatgccgatagtccccagaaggaagaggacaacggcaatactcataatggccaaaaaccttgaatggaaaaaggcagaagaccgcttcttgttcttttgtgacattcttattgctatatctcagagaaagaatgggagactgacaccctcttccggccggcggtggttttgatcatcgacggatccgtttcaggggatcggtggcctgtcattgtttcccaaaaggccaaaacaccccaatttctccgcaaaaatagtatataatatggtatgcgactatattttctcgagcgagaaaaatcctgtagggtcaatccctaagggtagtatatattaaaaacggagtaggggggctatgccgagaggccgggcaaaagctctccggatggtttctttttatcttgtctccatttgtcgtttcggttccgaaagcagataaaaagacatgttttactgtttcatctcatttgccggatcgtattttacgaaccgtaattctcgaaattttggtttgtgtttttgaaaaaactggaaccggaattttttcgttttggtttgggaattttttacttcccgaaccaaaatgaaaattttctcgaaccacgtttttcggagcgtacaataggaaaattttggagtgacgtgtactgaaaagagttgacactcggagagtgttaatttcgagattaaaattacagagatttctctaaagtccattatgggtttacacaccttactctttaagacgactttcggttgacagccgctaaatccgccctctggcggggagtcattttgcgatagagcttgggcgagattcggggggggattctcttgggggatctacaaaggggcattactcgttcttttctgtagcaatatgccgaaaatctacatgatatattgaaatagaggggaatccatgcttttaaacagggagtcatcatccggtcactactacacttttgagaactggtctgcagttatagcagtaattgtgtcggaaaatgaccgaatgatgactgtcaaaacatagagataagcggtcaaagaacaagggggataaaaaagaaatcgctgtaaaaccttgattttacagcgattcatcttaaatatgaaggtctaattgacatcctatgtgacatcgctttgagacctattagcggtatggacgggaaaagaaccgtccattgtatcctttttattttcagtgtcttagaaggaagtctttgcctgtgtaaccaaaatgaaaccaaagacagattatcttcagacgatgctcagatggcgtttttttgacgtccttagataaaggagcaaaggaaattcattttgcttttcaaactcctttcagactaactgaattgttccagcggtgcgtgcgggatatgaatcaatccgtatcaacagtcttatttccaactatttaatgagtggtgtttgtcgtattgcaacca

SEQ ID NO: 514 - DNA (genomic), 4710 bp, PORYPHYROMONAS GINGIVALIS; double-stranded, circular
  misc_feature 1...4710
  hypothetical: NO
  anti-sense: UNKNOWN
ggctcaagagattctggccaagatggataacagcctgccgcgtctggccaaatgcgacatgacaagagctgaccggtagcttccgaggtatgggaccggcaaaagcagtcaccgtgatggcagcaatggaactgtcccgccgtatcccttcgcaagagatgccccgcagagaatccattaccgatagtcgaatggcctatcgaactataagcccatttctcacagacctgccgcaggaagaaatgtgggtgttactcctcaaccaaagcggaaagataatcagcatggagaaccttagccgaggaggtgtatcggagacttcggccgatgtccgtctgatcatgcacaaagccgtctctcatcttgcctcggcaatcattctggcacacaatcatccttcaggaacggtacgcccaagtgaacaggatattcagcttactcaaagggtgcaaaaggctgccacattgctcggatttcgactgaacgaccatctgatcatcggtgacgatggggcatatttcagtttcgctgacgaaggccttctctgatttttctctgaatccatacaagtaaatagagagtcggactctttcttcttgtttgaaaccgatgagaaatcaaccaccggaacaaaaaagccgggtcatccatttatatcgccgcatagcaagagtacccggtgtcgcataggcgacatttcaggcagatagcagcttctacttttgtgtcatcaaagaacaatgatcgattaacataagaaggagactcgacaatggaaaagaaaatgttttgctatcaatgccaggaaacagccggcaataagggatgtatcctcaaaggggtatgcggtaaggactttagtacagctaatctgatggatttgctcgtctttaacctcaaaggtattgccatcataatgacttctatgaggcgtgccggagtgaaagccgattaccgaaaggctgacaaggcgatcatggaatctctatttgccacaattaccaatgccaacttcgactactcttccatagccaaacgtgtagagaaaacgttcgcactcaaagcggaattgtacagtttggcttttactcaaggcatagagcttcccgaaaatgaagcagtgacgatgcagggaaagccggaagaatatgatcggttggctctcagtgtaggtattctaagagagacagacgaagatgtacgttctctcaaagagctgacgatctatggactcaaaggattggcagcctatgcggagcatgcggatcgactcggctacgtggatgaagagatcaatgccttcaccgaacgtgcgctgcacgatgtgacgatgggattgctttcggcagaagagctgacggctcttgtactggaaaccggttctttcggagtgaaggtaatggctctgctcgacaaagctaataccgagacttatggcaatccggaaatcacggaagtaaatataggtgtcggttcgcgcccgggtatccttatcagcggtcatgatctgaaagatatggagatgctgctcgagcaaactgaaggaacaggaatagatgtgtacacacacggtgaaatgctaccggccaactattatcccaaattcaaaaaatacaaccacttcttcggcaattacggcaatgcatggtggaaacagcgtgaggagttcgaaaccttcaacggccctatccttttcaccacaaactgtatcgtcccccctaaggccaatgcttcctacaaggatcgggtatttaccaccaacgctacgggctatccgggattcaagtacatcgagagcgatcagcacgggcgcaaggacttcagcgaaatcattgccttggccaagacgtgccaacctcccacagagattgagagcggcactatcataggaggctttgcacaccatcaggtattgagcatcgccgacaaagtagtggaggctgtcagcagtggagcgatccgcaagtttgtagtgatgagcggttgtgacggccggcagagtgggcgcaattattacacggagtttgccgaagctcttccttccgatacggttatccttacatcgggatgcgccaagttccgatacaacaaattgcagcttggcgacattgggggcatccctcgcgttctcgatgccggacagtgtaatgacagttattcgctggcggtaattgccctgaagctgaaagaagtaatgggattggatgacatcaacaaactaccgatcgtctacaacattgcatggtacgaacagaaagctgtcatcgtcctgctcgctctactcagcctcggtgtcaagaacatccatgtaggccctaccctacctgcattcctatcaccgaatgtagcgaaagtgctgatcgaaaacttcggtatagcaggtatcggtacggtcgaagaagatattcggacgctgatcgcataagaataagaagtggtgtgcaagtgaataccttaagctttctcggaaaagccggaactgcattggtttattcctccatcttcttgaggtatagacacaaaagtattaaatactctgtgaaaagctttgtaagcttttcacagagtacttagaaccatttcgatgaatagttaaaactatttcgcggaaagcttaagagcttttgccagaatagatcctaatctttcttcgaaaagtggctaatcaaacgtgagttcgatgtaagcgatatggtgccgactctctcttgttgggatattgactataatcgaatcagaaaatgaaagggaaaaagtttgacgtctcatcggatgtcgaagcctctcgaagctgaaatttctcaaccgagaaatgaaatacgctgacaaacagcatattgcatattttcttcagatcgaatccgcattgttttatagccattcggaacatacgccgaaagggggtcgagctacgccctacagcgactcgggctacgccgtagagcgtaccgagctgcgctctacggctcttcaagctacgctgtagggctcaccgcgccgggccctacggctcagctcggccacatctacggctcacggagcggaactctacggctcggctcgctacgctgtagagcgtacctcgccgagctctacagcgtagctcgaagagccgtatgggatagcccgttatcctctacggaataccgccatctgccttgtggtatagcccatcttccggtgcggactgcaacattcggtcaaaagcaatccgaatttcaatgttggtccgatccgggcagaagcaggattgccccctatacaattgcctgaacggaacaacctataactcccaagatcttagtgtgtaacccgctaatcggggaacgaatacattggcgttttcttacgccgaactgacgttaatcaattgtcgcaagggacatcagcaaaaaataaaaccccgaaagtttttgtctgaactttcgggattctctgaactttagttgttcttgttatttgtcgaagaaaagattcgggtccatctacacctcatggattttgtacaatcggatcggatcttttgatgggttttcttcacacatcaagcggcttattctccgaataaagaacgcagttcacgaggcaaatagaaagtcttagtcttatctacatagactactacggaagacagatcaatcgctttcttattgaagataaccgtattggagaaaggactcgccagtaagcgatggctaccttttttcacttcaagaacaggcagttctccttccttctttccgtctttgatactgtagctcatgccttggaatacttccgtatggggagcaaatatcttgtcggtaaggacgggcaattggcttcctaattcgaagagacggcagagatagtcattcagttcatagtttatgaccattcccatcgggcgtgtatctttgggggtgataggccgccancaatacttcttcggcagtatgtccgtgcgtcgtaaaaccgatcgaagtgtgcttcgtataaagcgatgcgatgaaggtactgagcgaaccgctgtagagggattcttccgtctgcctgcgctgctctttggggataggactatgattataatccggacaattataaagagcttccaactctttggcgtccaattcgaatccgcagatattgcttaccaaaccctggaccttgtcggcgggagtatcagccaaacgccctgcaagtccgtctgctgtcaggcggaagcgacagagttgatcgaaaaggtcttttgcagaacgcttatcatagtctttcacactttgtttgcctatgcttacaccgctattgccatgatccggcacgatgatgacagccgtttgtccgtcacgacgggcaaagtcgaatgccacggcacaagcacgatcgaaagcaagatattcggtagcaatccccacaggatcgttggcatgtgcagcccaatccactttactaccctcgaccataaggaaaaagccttcctcagaacgattcagcttctctatagccaagcgagtcatctcctccagtgaagggatttgtgtagtatcacgatctaaatcatagggcatttcccgtttgccgaacaaagcccacatcctatctcccgcataagtgcgcattccattcaggtcatccagaaagagcccatagccacggctattgagtacggatttgcagttcccgattggangtagtgtgttcccgccttccgagtacacattcagaatttgg

SEQ ID NO: 515 - DNA (genomic), 569 bp, PORYPHYROMONAS GINGIVALIS; double-stranded, circular
  misc_feature 1...569
  hypothetical: NO
  anti-sense: UNKNOWN
tgcgctatgtaatggagcagattctctttgagttgtgagcgcagttcccatatttcttcggacgggatttgctctattatttcccaagcggattcttcagcctgacggctgagaaaatccgtgccaagatgccgttcatagaacctctgactctccggagaagcccaggtcggaaggtgtacgccattggtgacatgtcctacatgcagctcttcggcaaagaagccgggccatacgggagcgaacatccttcgcgagactactccatgcagatagctgactccattggcctcctgacaggtgttgagtgcaaagacactcatggagaacttttcgttcgagcccggtgtcgttcgtcccatgtcgatgaactcctgccagctgatgccaagtctgcgaggaaaatgtcccatgtaacgccccaaaagctcttcatcgaagtagtcatgccctgccggtacaggggtgtgaaccgtgtagagcgaggaggaacgaacagcttcaanggcaatatcgaaactcaatccctttggttcacatagtcnggccagacgttgagcattgatcaa

SEQ ID NO: 516 - DNA (genomic), 3369 bp, PORYPHYROMONAS GINGIVALIS; double-stranded, circular
  misc_feature 1...3369
  hypothetical: NO
  anti-sense: UNKNOWN
caaagatacggtccatcgcttggtgcatgaagaagaagatggccttcccggccttattatagatgtatatggacatacggcctnatgcaggcacacagcgtaggtatgccnccacgcacgancggatatagcgaaggctcttatagcgacgactgcaggcttggtagatgccgtttattacaagtcggacagtactctaccattcaaagccggactggaatcggccgatggcttcctgatcggttcagcacaagccgaagcagagtacgaaaacggacttctcttcctgcccgactggatcaaaggacagaagacggggttctttatcgaccagcgagagaacagggccttgctggaggagtatgcctccggacgtaaggtgctcaatatgttctgctatagcggtggtttctccctgtatgcaatgagaggaggagcatacaaggtacactcggtggatagctcggccagagccgtgcatctgttggagaaaaatatggcactgaattttgccggagacgatcgtcacgaatcttatgccgccgatgctttccatttccttgacgagatggctgtcggagcttatgatctgatcgtactggatccaccggcttttgccaaacatcgcaaagtgctgcgcaatgcgctgataggttaccgcaaactgaatgcggtagcttttcgcaagattgctccgggaggcgtgctcttcaccttcagctgttcgcaagcggtcagtcgggaggaattccgtttggcggtctttaccgcagcagcatcggccggcagaaaggtgcgaatactgcatcagcttacccaacctgccgatcaccccatcaacatctatcatccggaaggcgaatacctgaaagggcttggtctctacgtagaataactacatcgaggaataaaagtcccggccctatgcctcatgccgtccttggngggaataaaggatcaatggtaacgatcgtaaagccgctccaattcgcctgacaagcgaagccgatcgaaccaactattgagactgtcctgcaaggaggttgcncttcggcgcaccaaccatgcctgtcgcagttcgaaagagagcggtacactgcagtccaacgcagggaggagttgccccagcttcttagcttcatgttggttacagacggtcagatcgatgtcgtccgatgccaccatcatggccaactgctctgcagaataagtgggatcggttcgtatatatatactatccccgatttcctcggacaggtgtttgacgaacaacctcgccggagagccttccggaatggtcaccgtccgtccggacaaatcgatctggcgacgaatcagagcagtatcggatcgacgttgtaccagataaagccgtccaaggtgtatcggacgaagaaagcggtagtggacggtgtccgttacagccgtcagcggaatgtcctgtgcaatgatgtcgcatgcaccccgtcgcaacctttcaaggctctctttccaattcttttccagaccgatttctatccgaatgccactgatttccgataaacgacgtgctacatcgtaaacaaaaccggcggtggaatcctgtcccacataatagtctctgtcattgtatcgggcaatgatcctcagcactccttctcggtgaatatcaggataatcacgcaacgaatcgacagcgtccccaccggcagcccctcctccaccacagtggcgcaaagcaaccatcacgataaggacagagatcagtaaaacgccgtagagagcaatctgtttcttcatttccatttatttattgaagtcgatggcaatacccatacgcagaccacgagggttgtacggcgtatgcaccaaagagaaacgcttgctatccatgaaagcctcagccagattgtacatttcaaagaagaaacgtgagcgcttgaggtggatattcacataagcattcatcagagggaaagaccctcccacctttatctcttgttgcgtggtgaattgctgtacggcgggttcanaatacggagcatagtaggaggaatgaatgcgagcatccactcccgtctgtatacgcatcaccttggtactgctcggcagacggaagtccaaatagagattgccataagccgccagcttcggtaaaggcaaagccgtacggttgctacttgtttgataagccgcttccacttcccatcccaaagcaccccatcggtaggcatgtgctatccgcccttcgaggacttgtatgggagaagagacctgttgggggaaagccgtatggtcgaaatatatatagttcttgagcgtagcggattgcaacgtcaaggtcgtaccccagtccttcagacgaagagagccacccatctgagttgctggatgaaatcgaacgattcgtcccaccagtgcacagtaccatgatgatgacgcagaaagtagcccggacgagtattgagaagttgcccccaagcttccatttccgtcttccgacgaaggagatcgaacgctgtacttaatcgtcctctgagtttgaatgctccggcatcgctcccgacgaccgaaagctctccatcggctgcaaagttgagatatttcccccctcgtcggctgatctctcccccgacataagtgctgaactccctgtccgtagggggtacaccgactactgaatcttgtagcgtataaaacctattctccaacctgacataagccgtcaggccgaacttagcccagcgatggaaaccttcccgcaaagaaagagccagcgtattgtggtactcttccatacgagtggtgtcgttcggcagcgtgatcatctctccggcatcattcagtcgtttgataaacagattgggataaatcgaattgtccaaaggattcttgaccttgaagcgacggcgacttttggtataattgaaagtgtgggaaatactacccacgggcacgaataccatcgtatcgatcaaatgaggagcctcgaattcattgccatcataatactcggtctgtccctcacgatagaaaccgaggttgtagcgatgggtcagacgagccgttccttgccgaagcgaattgaacatattattgccgggaaacttcaccggaatatccgtcgatacgaattcgttcgttccattggcaaaattacccggatggatcacgtagtcatcattcgtaatccccccattctccgtcatcagatagtaattgttgcccacataagcataggcttcgtaacggtcggaacggtagctgccgaagaaacggtaggagatggctttcgtcttgttggagttgtagaaaccgttgctgtagatataatccacatcgttaccaatgttgactcgcttgcctatattcaaagccaaagtagaacgc

SEQ ID NO: 517 - DNA (genomic), 286 bp, PORYPHYROMONAS GINGIVALIS; double-stranded, circular
  misc_feature 1...286
  hypothetical: NO
  anti-sense: UNKNOWN
ttgccgctatgaaaggactggcctctgtccttgaggctgaagtactccgggaatagcaccgataatatcgattgccacgaatagaatcacgaaggagcctatgatctctttcaggtcgataaggctcaaatcttgtaatactttgtctaaaaaatccatcgtttctgatttgtttgatagttaaggttggaaggtccggttggttgtcacgatcttgacagtcgcaaaattaacgtttttcgccctatcgaaagataaccatcggcgaaaaaaggtactgccggcc

SEQ ID NO: 518 - DNA (genomic), 636 bp, PORYPHYROMONAS GINGIVALIS; double-stranded, circular
  misc_feature 1...636
  hypothetical: NO
  anti-sense: UNKNOWN
gtactcagccccgtcgtacaggaaccgagaaaatggtgcaacgtacagcaggacgacctgcaggcgttgcaactcaaaagagaccggctggaagaggaagcctgtaaacgggacaagtcgagagcctatttggtggatgacgaagcgtggaataacaagatcgaagagatgggttttatcggcccggaagatgcgattaccctggccggcatgtatgccgaacgtacggcgttcaacgccaagcgctggtttataaaaaaggtttatcaactgttggaactgctctttcatgccgtcagtctggtcatcgacacgctccgcacattctttctgatcgtgctgtccatcctggggccgatcgtgttcggtatcgccgtatgggacgcactcagcggatcgctgacagcctggttcagccgctacatctccgtctatctctggctgccggtcagcagtattctgacagcactgctcacgaagatacagatcctgatgctcaacaaggagattgcccagttgcaagacgtgaactatatgcccgattcgggaaactggtactacatcgtcttcttcctgatcggcattctcggtttcttcagcgtaccgactgtttcgggatggatcatcgaagcgggc

SEQ ID NO: 519 - DNA (genomic), 553 bp, PORYPHYROMONAS GINGIVALIS; double-stranded, circular
  misc_feature 1...553
  hypothetical: NO
  anti-sense: UNKNOWN
aacggatcacccggcgcaggatcggggtcgtattgagtgccggagcagctctctatctgctgaacgnatggatactgagcctgccggtcggcatagaccttcgggctgtctgctacctccttacactgagcgcaggatttatctgtctgctgatggccggctcctggatcagccgcctgttgaagcacaacctgatggacgatgtattcaatgtggagaatgaaagtttcatgcaggaaacccgtctgatgacgaacgagtattcggtgaatctcccgactcgtttttattaccggaaaaagtggcgcgacggttggatcaatgtcgtgaatcctttccgcgcgagcatggtgctcggtacgccggggtcgggaaaatcctacgcgatcgtaaataactacattaagcaacanatcgagaagggatttgccatgtatatttatgactataaattccccgacctttcccgagatcgcttacaaccatcttgcttcagacatcggaagggcgtattgaagtgcagcccgaangttttaccgtaatcaactttcga

SEQ ID NO: 520 - DNA (genomic), 453 bp, PORYPHYROMONAS GINGIVALIS; double-stranded, circular
  misc_feature 1...453
  hypothetical: NO
  anti-sense: UNKNOWN
gccaatcagaacaatccttacttccgaccgaatcgagagtttgcctttcttcgccatacaacggacgaaatacttcttgtcgcagccaattttgccccacacgaagcagaaatcagggtgattattcccgaacacgcctttcagacgatgcagataaaggacaatgcagctttcctgctgaccgatatgctctccggagaaaacagcatcggctgtctcacccaatacgccccctacccgctacatcttccggcctacggctatgccctgcatcgcttccgtccgctttagacggatcaagccaattctcctatagctctttcaacgggtgcaaaaaacaaacgagggtgtatcgaaaagaatgaaacatcctcgttcttataaagagaatcgtatgctgtttgaagcatatgatcagtaggaattttagttnttccaaaatctgaaaacttt

SEQ ID NO: 521 - DNA (genomic), 972 bp, PORYPHYROMONAS GINGIVALIS; double-stranded, circular
  misc_feature 1...972
  hypothetical: NO
  anti-sense: UNKNOWN
gcttgggcgcagtggactttacggtggcgctgcactacgtattcgatacgccctacgaccgtatcgtctgggacgtgggacatcaggcttacagccataagatcctgaccggccggcgcgaagacttccgccatttgcgccaatgggggggcatcagcggtttcccctcgcctaaagaaagcgaatacgacacattccctgccggacatgcttccaactctatctccgcagcacttggaatggctgtggcttcggctgccaaggatgagaaacggaaggtcatagccgtcattggagacggttccatgacgggaggtatggcttttgaagggctgaacaatgcatcgtctttcccgaacaatctgctgatcatcctcaatgacaacaacatgtccatcgacaggaatgtcggaggactgaaccgctatatggtggacatcctcactagcaagacgtataatacgattcgttacgacctttataagggcttgcgaaaaatcaatctgatcagcgagacgaacagaaaaaatctcctgcgcttcaacaacagcttcaaggcactactggcacgcgagagcaatttattcgaaggattcagcatccgttatttcggccccgtcgatggcaataatgtgctccgcttggtggaagtactcaatcagatcaaggatatggccgggcctaagatcctgcacctgcgaacgatcaaaggtaagggctactctccggccgagaagcaggctacgatctggcatgcgccgggcgaattcgacatcaaatcgggagaacgtaagaaaggagagaacaagcccgagccacccaagtttcaggatgtgttcgggcatacactcgtggagctggcggacagagacgagcgtgtcgtcggggtcaccccggctatgccgacaggttgctccatgaccttcctgatgaagaaatacccgaatagagcctatgacgtgggtattgccg

SEQ ID NO: 522 - DNA (genomic), 782 bp, PORYPHYROMONAS GINGIVALIS; double-stranded, circular
  misc_feature 1...782
  hypothetical: NO
  anti-sense: UNKNOWN
cacgcactctcgccgaatcgccttctcttacttacagaataaatatgcctgaaggacttttcggagatgttgctgctaagattgcagatcgtcccggtggatatacccgtatcttgaagaccggttatcgtctgggagataatgctgctatgtgctttattgagcttgttgactacaatgagaatatgcttggcgaagcagcgaagaaggcgaccaaaacacgccgttctcgtaagcgtaaaagcgcagacgttgtagtagaagcagctcctgcagaagaaactcctaaagcagcagaagaataagtcgctgcatcggatataaataactttaatagagagggcgagctagaacagatgttctggatcgccttcttttttatgtccgaaaagaaaccgtggtctctttaaggagacctttgcacggcaattagtgtgtattttgtttgttaattcattgtataatagggagttattttgtatatttgagtattaaaaacagcataatattcctcccatggcataccaatccaagaataccgatgagcatgtaacatttgcagacgcactcctttcaaagcgttatcgcaaagcacaaaacgacttcctcaatcaggttgagaggcttatcgattggcgtccgatcaggacgctgatcaacaagaaatacaccaagcgacaaaatgccatcggcgccccggcttatgacgtgattctcttattcaagatgttgcttttggagacatggtacaacctcagtgattgtgctttggaggagcgcat

SEQ ID NO: 523 - DNA (genomic), 8554 bp, PORYPHYROMONAS GINGIVALIS; double-stranded, circular
  misc_feature 1...8554
  hypothetical: NO
  anti-sense: UNKNOWN
tccngctgtctcgctctccttcggggcctgttcttggcttggttacttggcataggcgtactgctgattcgtttcggtattcgcctccgttccctcctgtgtcttatttgcggtgccgaacgggcggagatagagggtgtacccgtttactttgctcctcgtgtaaggatgccgttcagcttctgtaggcgtatttatcttccgaccgatctgcgctcatacccttctgtgagaaatgttcttatccatgaacaagaacatacccgagcaacgcactttgtcgatcttttgatcgccgaagtggcatgcatgctgttttggttcaatccgtttgcttgggctttgaagcgcgatatgcagcgcaatttggagtttttggccgatcgggctgtgctcctcagaggcgtgagcagacgcgaatatcaatatgaattgttgggatttacgctggaggtcgcggccggacctctgtgtagttcttacaatataaacgacttaagagaaagaatcagaatgatgaacaaaacgaaatccaatcgtgcggccggagccaggtatcttgtcgcactcccgttggctgcccttatgcttctgagcggtaaatggctgtgggcgggcaatgccgtatccgaagtccgggaagtagtagcaaccgttgcgagcgatcccgcccccttgtctgatgctcctgacatctccctgcagcaggacgaggatcctgtgtgttccgagctagatactccaccatctttccccgggggaatgtccgaactgatgcactttctgagcaagaatttaaagtatccggaacaatctgcaaagaacagcatccaaggtcgagttgtggtctcgtttattgtcgaaaaagacggcagactgactaacatacaagtggaaaaaagcgtagcacccgaattggacgcagaagccgtaagagtgatttcagctatgccgaagtggagtcccggcaaacaaaaggacaagaaagtccgcgcgagggtaaaccaaccagtcatattccgcctgaagtagaccttccgactgcctcggaaaaacatgactctatccaacaatgccctaagccgaaaaaggtttagggcattgttgtaatcggtcgaattttaccatccttgctgagataaaaagaccgatggctccgagagttttatttgtggtgccaaaagattgtgatccgtggttctgaaaaacgtggcgcgggaaaattttgcttttggtttgagaagtgaaatttttgcgagccaaaagaataatttttaggctcgagtttctcgaaattcacgaaccatgttttgtccatttatggttcgtgtttttgtcgaagaggaaggtgcccgattccttttttcggcggttcgagtttgttggcatcgggatgcgagtatgcgtatgccgagtggtgtgccgattggtaagggggcacaagtgtcattcgcaccggcatagcttcgtccactcctgctatgccggaaatcaagcctaatcaaagggtttctaaggctctatatcttttgacgttgtcggtcagagtgtacttttgcctaagaaacaatgatctcgactctgcacaggatgggagtgctcgtaatggcttctaaagtactgatttgctacctcttatagttggcaaacagtgtaaaagctttctttcgataaagacctgcggaatatgggggcaaaaggtcggaaaaaactatgtggaaatttttcctcaaatgcctccatacttataggtatatataggggaaaaagctacttttgcgacacaaattggaataataattctgtgtcatggcaaaagttataaaaacaaaaaaaggccttgcacttaatctgaaaggaaaaccgctgcccgagatgctggccgaaccggcccaaagtcctacttacgcggtcgtgcccgacgattttgaaggtgttatccccaaggtgacggctcgtccgggggataaggtgcgtgccggctcagcactgatgcaccacaaggcatatccggagatgaagtttacaagtccggttagcggcgaagtgatcgcggtgaatcgcggtgccaagcgcaaggtgttgagcatcgaggtgaaaccggacggactgaacgaatacgagtcattccctgtcggggatccgtctgccctctctgccgaacagatcaaggagcttttactgtcgagcggtatgtggggttttattaagcaacgtccttacgacatagtggctacaccggatatagctccacgcgacatttatattactgccaactttactgcaccattggctccggacttcgatttcatcgttcgaggagaagaacgcgccctgcagactgccatcgatgccttggccaaactcacgacaggaaaggtgtatgtgggcctgaagccgggttcatctctgggcttgcacaatgcagaaatcgtagaagtacacggacctcatccggcaggtaacgtgggcgtgctgatcaatcatacgaagccaatcaatcggggcgaaacggtgtggacgctcaaggctaccgacctgatcgtgatcggacgtttcctgcttacgggcaaagccgattttaccagaatgattgccatgaccggctcagacgctgcagctcacggatacgtccgtattatgccgggttgcaatgtctttgcttccttccccggccgactgacaataaaggaatctcacgagcgtgtgatcgatggcaatgtgctgaccggtaagaagctctgcgagaaggagcctttcctgtcagcccggtgtgaccagatcacggtgatccccgaaggcgacgatgtggacgaactcttcgggtgggctgcaccccgtctcgatcagtacagcatgagcagagcttatttctcttggttgcaggggaaaaacaaagagtacgtactcgatgcccggatcaagggtggcgaacgtgctatgatcatgagcaacgagtatgaccgcgttttcccgatggacatctatccggagtatttgctcaaggctattatagcattcgacatcgacaagatggaggacttaggcatatatgaagtggctccggaggactttgccacttgcgaatttgtggatacatccaagatcgagctgcagcgtatcgttcgcgagggcttggatatgctctataaggaaatgaattgacgaatccctcacactctaaagcataagacattgaaagcgttaaggaatcaactcaacaaactgaagcctcattttgaagaaggcggcaagctccatggcctgcactctgtcttcgacggcttcgagacctttctctttgtgccgaacaggacatcgcagcatggcgtacatgtgcacgatgccattgatagcaagcgcacgatgatcgtcgtgtgtatggctcttttgccggccctgctcttcggtatgtataatgtgggggtacaacattatatggccatcgatgctcccgtagtattttggccggcttttctcttcggacttctcgccgtactgcccaaactcattgtctcctatgccgtcggtttggggatagagtttgccgtagctcagtaccggaaggaagaaattcaggaaggcttcctcgtatcgggtctgcttatcccgatgatcgtgccggtagatactccgctgtggatgatcgccgtggcgacggcttttgccgtggtttttgccaaggaggtgttcggcggtacgggacgcaatatattcaacgtggctctcgtgacgcgtgccttcctctttttcgcctatccggcggctatgagtggcgatcaggtttttgtccgcacggctgataccttcggcctcggcgcaggtacggtagcggacggcttctccggagctacacctttggggcagatagccacggccggtgccaagatgcctgaaatacataatgtggcaggcgacccctcttccctgatggatgctttcctcggctttatacccggctccatcggtgaaacctctactctggctatcctgatcggagctgtcctgctgatttggacggggatcgcgagctggaagatcatgttgagcggtttggtaggagcctcagcaatggctctcgtattcaatgccatcggcacgacggcggcgatgcagatcactccgctgatgcacattgtctatggaggctttgcttttggcttggtatttatggccaccgaccctgttacttctgcccgtacagaaaaggggaaatggatcttcggtttcttcgtcggtctgatggctgtattcatccgagtgctcaatccgggttaccctgaagggatgatgcttgcgatcctgctcatgaacgtatttgctccgctgatcgactatttcgtggtggatagcaacatcaaagcgcgcaagcacgtatgctcaagaaatcctaaccgctaaatatttcgataaagacatgaatagagataaaaactcgtacaccattctctatgcctcggtgatggttattgtcgtggcggttttgctggcttacgtctctcagtcattgggcgacaggcagcgtgacaacgagaagatagacaagatgcagcagatcctccgctctgtgaatgccggaatagaagataagggcaaagtaatagctcggtacacggacgtgatcaagcaagaactgctcatcaatcaggatggtacggtagccaagaccttcgagggcgagcagttggcacaaaatgaagcattcacgctcaatacgcgcaatgctttcaaatcggccgctaatgatccaagcatttcgctccctctctatatcgcagagatagagggtcagaagaaatacattgtcccgatgaacggtgccggtctttgggggccgatctggggatacattgcactgaacgaagactgcaatacgatattcggtgcagatttcagtcacgaaggcgaaacgccgggattgggagccgaaatcactcgctcggagttttccggtcagtttatcggcaaagaaatcttcaaagagggcgaattccgatctgttgccgtagtcaagaaaggccagaaagccgaaggaaaggactatgtggatggcatttcgggcggtacgctgacgagcgatggagtgaatgagatgctcatatcctctctccgtccttatgctctatacctaatgaacaacgtaaaaaaataagggctatgtcactttggaataaaaagaataaggaaattcttctcgggccgctaagcagcaacaatcccgttatcgtgcagatgcttggtatctgctctgctctggccgtaacagccaagctgcaaccggctattgtcatggccctgtcggttactgcggtagtagcttttgccaacgttattatctctctcctgcgcaatacgatccccggacgcatccgaattatcgttcagctcgtcgtggtcgcagctctggtgactatcgtgagtcaggtactgaaagccttcgcttacgatgtgaacaagcagttgtccgttttcgtcggcctgatcattaccaactgtattttgatgggacgtttggaggcttttgccttggccaatcgtccttgggagtcattcctcgatggtatcggaaacggtctgggatatggatgggttttggttattatcgctttcttccgcgaattgctcggctccggtacattgctggatataaaagtcattcccaagagcttctacgaatcgggttatgtcaataacggtctgatgatcttgccgccgatggctctgatcaccgtggcagttgtcatctgggtacatcgtgcccgtaacaaggatttgcaagagaactaagtaggacacgcctgataatcaattaagacagtatcaattatggattacataagtatgtttgtccgctcgatattcgtggacaatatggtttttgcctactacttgggaatgtgttctttcttggccgtttccaagaatgtgaagacctctatcggactcggagctgccgtgactttcatcttggtctgcaccttgcccatcaactatctgttacagaactatattttcaaggccggtgctctttcttggctcggatcccaatatgccgaagtggatctgagcttcctctcactgatcatctttatcgcggtgattgcatcctttacgcagctcgtggaaatggtggtggagagattcagcccctccctctatgcttcgctgggtatcttccttcccttgatcgcggtgaactgcgcgatcctcggaggatcgcttttcatgcagcagcgtgagtttatcaatgtcgggatggctaccgtctatggattcggctccggtatcggctggatgctggctatcgtagggatggctgccatacgcgagaagctggcatattccaacgtccccaaaccgntgagagggttgggtatcacttttattatcaccggtctcatgggtattgctttcctgagcttctccggcgtgaaactctaaaaagaacgaagtagaaatatgagtacagtaattattgccagtgcagtcgtattcctgctgctcacgctgattttggttgtcgctctgctttatgccaagagcaaattggtgccttccggcaatgtgacgatcaccgtgaacgacgaacgcaagatggaagtacctcttggcggtaccttgttgaatacgcttcaaaatcagggagtattcctttcttcggcttgcggcggtggcggaagctgcggtcagtgtcgttgccgtgtagtggaaggaggtggcgaaatccttccgacggagaagggatttttctctcgcaaagaacaaaaggatcattggcgactttcatgtcagacaaaagtaaaggaggatcttagcatcgttattcccgaagaggtattcggtgtgaaagaatgggagtgtgaagttctctccaataagaatgtctccactttcatcaaagaatttgtggtgaagctgcccgaaggcgagactatgaacttcaagagcggtagctatgcccagatcaagataccgaaatacaacatccgctatgccgactacgatattcaggatcgcttccgtggcgactgggacaagatggatgcgtggtcattgacttgtaagaacgaagaagagaccgttcgtgcctattcaatggccaactatccggctgaaggcaacatcattacgctcaacgttcgtatcgcgactcctccattcgacagagctgccaataagtggaaggccggtatcaagcccggtatttcctcctcatatattttctcgctaaaacccggagataaggtgatgatgagtggcccgtatggggacttccatattcaggacacggatgccgagatgctttacattggtggtggtgccggtatggctcctctacgtgcacagattctgcatctcttccgtacactgaagaccggtcgtaaggtctcctattggtatggtgcccgctccaaaaacgagattttctatgaagaagacttccgcgagatagagagagaatttccgaacttcaagttccatatcgctctttccgatcctcaaccggaagataactggacaggctatgtgggctttatccaccaagtgatctatgacaactatctgaaggatcacgatgctccggaagatatagaatactatatgtgcggcccgggtcctatggccaatgcagtgaaaggtatgctggagaaccttggtgtaccgcgcaatatgctctttttcgatgatttcggataagtttttccggcacattcgatttatcattcactggagaggttgcttccgttgggatagcagcctctctctttttctccgaagagttgngatggtaatgtgagtncgatgtaagcgatatggtgccgactctcataagatccgncttatcgatcaaactcttgttgggatattgactataaccgaattagggaaagaattattcattggcattttcttgcgtcgaactgacgttgaagggtatcctttgtncttcgnttttcgtacaagggacgtgtataaaaatgagaaaggctgtccggacattatgcctatcggacagcctctttcgctgtagttgcggaggcaagactcgaacttacgacctttgggttatgagcccaacgagctaccactgctccactccgcgatcaattgtggcacaaaggtaatcctttttgcctaaaaaccaaaccgaaaaagcaatatagctccaatttctaatagtaaatgcaacacaaagagaaaaacaaagaccgattaagaagtacctctaaccggtcaactcaaaagtttatttctgtgttgcaatgaaatacaaacaattgagtcagaggagtaaagatacatgattgatcggctcttgaaacagggtacccccctttctttcatcgctcaaaccattgaggttgaagagtaccgtctccggcaggcgtatcgcatttgaaagtttatactgtatccttggcctctttcttctgtaatttgggactctcgcacattaattcgtacttgtttgataaccgagtgtagcaatcgtttggtttataagtgtgttaacagttcaaatgtaattgtcctgaagccaagtgtaaggaaa

SEQ ID NO: 524 - DNA (genomic), 382 bp, PORYPHYROMONAS GINGIVALIS; double-stranded, circular
  misc_feature 1...382
  hypothetical: NO
  anti-sense: UNKNOWN
tggctgaattccatgtatcgagactccctgtcagatagccggtgatgcgtcgcaagcgagctatccgatcgctgccgcatacaggacatttgtcgtagatcacacctttgaagccacagcccttacaggtatccacaggatgattaatcgaaccatagccgatgttttcatccttcatcatcttgacaattttgaggataaccgatacattcttcttagcttcgccatccaactccacataagtaatatggccaccgccggtaatagcatggaaaggagcctcgcacttgatcttttcagctatacctatcgattcgcgaacatccacatggaaagaattgacgtaatagatgcaaaatccgttaccccggggataatcccg

SEQ ID NO: 525 - DNA (genomic), 639 bp, PORYPHYROMONAS GINGIVALIS; double-stranded, circular
  misc_feature 1...639
  hypothetical: NO
  anti-sense: UNKNOWN
tattcatccagataatagctcggataattgcggttgcatccctgcacatattccttgtgttcgggaacattccctgattcgtagtcttcgtcttcgacatggatgagacgattctcgtaagcgaaattatgggttgccataactgtttattgttttgtcagggttagaaaatgtttctctatggctgcattcagcagtgcatcatcgtcgtattcgtcctgagagaggctgatgctttccgcatctttgtcatagcagctttctgcgacataattttcccaactgtacaggcgtacatatccgtttcccttattcaccgaaaccacaggcacggtcttaaatccgacatggcacaacagcagttcggtcaattcacaggcacgatttccgtattcgcttgccacgataagaatggacacgtccgaacccgtttttatgcggtaatgcgaggaggagttatttcgtttcctgcgatccattgagtgatttaatctttcttgttccataatgctgacattttttttgcgtctaaagctcggagtgtgccgatttcgtttcgtgggctgttcaaggtggccggagggtatatgtcaaggcttcccgaaaaaatacgacttggaacgaaagtggaaatgtgga

SEQ ID NO: 526 - DNA (genomic), 509 bp, PORYPHYROMONAS GINGIVALIS; double-stranded, circular
  misc_feature 1...509
  hypothetical: NO
  anti-sense: UNKNOWN
tgagacaaaaacggattgccgaatgtattggtgacctgaagggctgctcccaatagcatggcaaagaggaagaagatagccatacgacgttggcggaaaaggacaaaagcatccagccccaagacggcaagcacccccttcttcttgttttcttttgcaggagggcagtgaggcaaggtaaaagcatacaatcccaatgcaagggaagccaccgcactgacatagaattgcatactgctcattacccatccgcatatatcgacggtccacatggccaaaatgaagccgacagtaccccatacgcgtataggaggaaattcgcgcactatatccataccggctttctccatagcagtataggctatcgaattggtgagagctagggtaggcatatagctcatgcagagcaggagcataacgggataaaaaacggagtaactactcagcgtggaagcataaaccagcaatatggctccgatcagatggcacgctcccaagagctttgtgca

SEQ ID NO: 527 - DNA (genomic), 494 bp, PORYPHYROMONAS GINGIVALIS; double-stranded, circular
  misc_feature 1...494
  hypothetical: NO
  anti-sense: UNKNOWN
acttcatcgccgtagcataggactcctttccctcttcctcgccacttttgatcttggcgaagacgaaaggatcgtaggcatagcgaaaggcctgggtgaacatcaccatgatgatggccagcttgtagcacgcgccatagataccgagctgtgctttcccctccgccggatcgtcgaaaagcatgggaaagagaatcttatcggcctgattgttgaagctgccggccaagcccaacagcagaatagggaaagaataggccagcatcttgcgcagaacgtccggacgaaatacgcggccggcatgccgccaatgaggaaaaagcatgaccatctgcacgaggntgcaaatgaagttgatgacgaacacgtaccccaattcgtagttcgggcggtagaagctatcgatccactccggatgtaaggcataaataccggggacacagggangaggaaaaagatcgtaaggacnatgggtcancaggattgaatgtcaa

SEQ ID NO: 528 - DNA (genomic), 139 bp, PORYPHYROMONAS GINGIVALIS; double-stranded, circular
  misc_feature 1...139
  hypothetical: NO
  anti-sense: UNKNOWN
tgtgcagacacttttaagataggtctgtaattgtctcagagtatgaatcggtcgcccgacttccttaaaaggaggtcgggcgacttcgtttttattattgctgtccggtaaacttgtcaagaggagacctttgaaaaat

SEQ ID NO: 529 - DNA (genomic), 494 bp, PORYPHYROMONAS GINGIVALIS; double-stranded, circular
  misc_feature 1...494
  hypothetical: NO
  anti-sense: UNKNOWN
gaattcttccttttttaatattataaacaaccagttcctgtttggctgttgtatctttttccttatcaatctcagaccaaagaatatatttaaactgcttggcatctctgtttcttgataattcagtaaaaataggtttgtgatattcgctactatctaaaaaagatttatatatctcatatgcagtacatgtcttaccaaatccagctgctgcttctacaacaacaagatgtgcaccttttctattgattgtttctttgattacagaaatgatatcagaagtcccatttatagcatcttctgcatcttctttgtaaatagagtaaggcatactgatgtactggtacttaatgtcactgccgcaataatgctttacttgattagtgggcaaattctgtgtatctcctattaatggcatttgcagtggtttgtggtgttaaaaaaaacctttaaacaaataacctctctgcttcttcnataggatctggaacctt

SEQ ID NO: 530 - DNA (genomic), 521 bp, PORYPHYROMONAS GINGIVALIS; double-stranded, circular
  misc_feature 1...521
  hypothetical: NO
  anti-sense: UNKNOWN
gggttgcatcgtaattacgggcacaagcatctcttcgagcgatatgcctccgtgctggaatgtattgcgatagtattgtacgtagtagttgtagttattcgggtaggcgaagaagtcatcctctttcgtgaagatgaatttgtccgagaggttgttatggggcagccctacacttgcaggatctttgatctcgaatacttctttcgggttgtagtcgaggttcttacctattttgtatctgaggttggtattggtacttctgtctccgatcactttgacgggattcttcacctgaatagtaccatggtcagtggtcaataccactttataacccatttcggcaatgctgcggaagagattgtaggtagtcgaatgcttgaaccagcttcttcgtcagcgagcgataggctgcttcgttggatgccagctctcgaatcatcttgctatcaagtacgagcatgcgacatcatgtccaccgaaagttcaggactatcacattgagttgggttctgcgacagtga

SEQ ID NO: 531 - DNA (genomic), 1665 bp, PORYPHYROMONAS GINGIVALIS; double-stranded, circular
  misc_feature 1...1665
  hypothetical: NO
  anti-sense: UNKNOWN
aaggacgaaccagatcaccaaaccggaagatttccgatcactactggcgttatcggatgcctatttctatcgaaagcctttctgaagactatcgggagctgaacgaatcgatagcctccctcattcgcacctcaggcagaggataagcttccgggccactgtatcttagcagctacctccacggtttttctctgaaagggatggagtggagttattttattattctgcgttttatcatcccttttgtgtacttttgcccacgatactaaagagttatagattagaaataaaaagacttatgcttaacgttgtaagtaagactatcgatctgggagatggtcgttccatcaagatcgaaaccggtaaattggccaagcaggccgatggcgccgtgacagtcaccatgggcaatacggtattgctcgctacagtttgtgcagccaaagacgctaaccccggctgcgacttcatgcctcttcaggtggaatacaaagagaaatactccgccatcggacgcttccccggaggattcactcgccgcgaaggcaaagcttcggattacgagatcctgacctgccgccttgtggatcgtgcccttcgtccgctattcccggacaattatcatgcagaggtattcgtcaatgtgatcctcttttcagccgatggcgaggatatgcccgacgccttggccggtctggctgcttcggcggctcttgccgtttccgatataccgttcaacggccctatcagcgaagtgcgcgtagcacgtgtggacggccgctatatcgtcaatcctactttcgagcagctcgaacgcgcagacatcgacttgatggtcggagccacaatggacaacatcatgatggtcgaaggtgaaatggacgaggtacaggaatccgaaatgctcgaaggcatacgcgtggcacacgaagccatcaaggtacagtgcaaggcgcagctcgaactatccgaagctgtaggaaaacttcaaaagcgtgaatacagccatgaagtaaacgatgaagacctgcgcaagaaagtgcacgacgaatgctatgctcgtgcctatgaggtggctaccagcggaaccggcaaacacgagcgcggcgaagcttttgaaaagatcgtggaagagttcaaagctcaatatacggaagaagaacttgccgagaaggccgaaatgatagctcgctactaccacgatgtggaaaaagaagcgatgcgtcgtgccatcctcgacgaaggcaaacgcctcgatgggcgtaagaccacggagatccgtccgatatggatcgagaccgactgcctacccggcccgcatggctcagctatattcactcgtggtgagacgcagtcgcttacgaccgttacgcttggtacgaagagcgacgaaaagctcgtggacgatgtactcaattatacgaaagagcgattcctgctgcactacaacttccctcctttctctacaggtgaagcccgtccccaacgcggtgtaggccgccgcgagatcggtcatggcaatttggcgcatcgcgccctcaagcgtatgataccgacggactacccctatgtggtacgtgtaatcagcgacattctggagtccaatgggctcgtccttcgatggccactggtctgcgccggtacttttggctctgcgccgatgcc

SEQ ID NO: 532 - DNA (genomic), 455 bp, PORYPHYROMONAS GINGIVALIS; double-stranded, circular
  misc_feature 1...455
  hypothetical: NO
  anti-sense: UNKNOWN
tatcggacatcctcaatatcacggccatggccgtactggacagccacgcctgtctgatttgattcaggtataaatccgtacaacaaatagaggctgtttcactgcagaaacgagcctctatttttcccttgcagctataagaaagcctatcggaagatgctaaggctaaaaagcaaagaggctgctccgcacgatttgcagagcagcctctttgtatttggggtttctatctttcggaaaagttcccgataagtcgccttttattgtccttaaatccgatggactgactttactcggtaggacattctgcccgcttgagtccgccggcggttctgccggcttccaagagtggcaggttggcttccgtcggaatgtagatcacggtcttgtcattcaggctgccctgcttgacgccacccatagatactgaatgtattgtgggcgtaaaggcttgt

SEQ ID NO: 533 - DNA (genomic), 548 bp, PORYPHYROMONAS GINGIVALIS; double-stranded, circular
  misc_feature 1...548
  hypothetical: NO
  anti-sense: UNKNOWN
gctcaagatgcttgccatgagcggtgaggacggaggaatcaagagtctgctcaatctcaacatcgtaccgctctctttgagctatgagtatgacccctgcgattacctgaaagcgcgcgagatgctcagcaagcagcgcgacccgttatataagaaacccgtcggggaggatctgctgaatatgcagacaggtattttcggctacaaaggacgtgttcactttgccataggtacacccctaagagaattggccgagagcatcccggcagatgcgccgcatgcccggcagttcacagaggcaggcaaactgatcgatgcagaaatccatcgtcgctaccgtctctatccgggcaattatgtagcatgggatcttctggacggatgcgaccacgccggttcgcattatagcaaggaggaaaaagagacctttgtaaactatctgtccgcacaaatcggcaaagtggagatgcaggataaggatgaagaggaattgaaacgactggattctgatcatgtatgccaatccggcaaagggcatattatgctgg

SEQ ID NO: 534 - DNA (genomic), 856 bp, PORYPHYROMONAS GINGIVALIS; double-stranded, circular
  misc_feature 1...856
  hypothetical: NO
  anti-sense: UNKNOWN
ggaagggttattgtgtaacggtctaatgaaaacgaaaagattattgccgggagagttgtgcaacggaaaagccatgaatccgatagtcgggattcatggcttttccgttagagtgagggagattgttgtcagcttagcaattcctttacgatcgtactgatgaggctgccatctgctttgcctgccaattctttggtggctactcccattactttgcccatcattttactgtcagtgacgccgagacggctgattatttcctgtaagatgggggtcagttcctcacgtgagagttgtttgggtaggtaggcctcgattacctcggcttcggcaagctcaggttcggccagttcgggtctgccgttttctacaaagatggcagcactctcgcggcgctgcttcaccatcttttgcatgatcttgagggctgcatcttcggacagagtgccatcgctgcctttagctgtcttggcttcgagaaattctttcttcactccgcgaagggcttcgagcttcactttgtcgcgagcgagcatagcggtcttgatatcgttgctgatgagttcaaagtagtccattgtataggcttatattggttcggatgtattgttaattgaatgaaatggtggtcggagagcttgaacgttcgctttcgaaggcaggtcgttcgctctcttccgatcggacaacatccttcttcagacgaccggccgattctgctatccgcatacgtatattgtcgatacgagagagcagtaccccggtgcgactgtaggccggtttctcttcgagggccatgatcagttcgtcattgtccaactcgtcgaggttaagtatgatcggtttgaagtccacc

SEQ ID NO: 535 - DNA (genomic), 508 bp, PORYPHYROMONAS GINGIVALIS; double-stranded, circular
  misc_feature 1...508
  hypothetical: NO
  anti-sense: UNKNOWN
ccgccggcaatgctttcttcccgtctttgatttctcccggtacgggtatgagcgatgtcactcagtcgcaaggagtacagccttacttctctatcgccataccgccgatgatgagcgtgatgacagctcttgtcctctctttcgtactcggcctgggtttggccggcatggaaagccgtggcatgaagggaatgatgcaggattttcaggagattatcaccaagttgatcgccaaggttattatcccattgctgcccatctatatcttcgggatctttctgaatatgacccatcagggcgaagtggtgaaggtgttgtccgtcttccttagtatcatcggtatcattttcggccttcatatcatcctgctgatcttccaatactctgtggcaggattcatagccaagaagaatcctttcagaatgctgtggcgaatgctgccggcttatttcaccgctctcggtacgcagtcttcggcagccactattcccgtcacgctcaagagtgc

SEQ ID NO: 536 - DNA (genomic), 973 bp, PORYPHYROMONAS GINGIVALIS; double-stranded, circular
  misc_feature 1...973
  hypothetical: NO
  anti-sense: UNKNOWN
ctgaccaattatattcgccctacggactttcgctcgatgactatttcatcaaccgcgaggattcgccacgcgatgaatccggagactatgatttcgaatcgctctacgctttggatctgccccttttcaataaggatctgaagcagatgatcgccggtgaagaagtgagcctgcccacctatgacttcgcaaccgggatgagggtctacaaaggaaataccatacagctgaaagacggagatatcctgatcctcgaaggcattcatgcgctgaatccggagctgatacccggtgtgcccgaatcaagtacgtataagatctatgtgagcgctctcactgcaataggattggatgctcacaatcggatccccagtacggacaaccgactgatcaggcgattggtgcgcgactatcgctatcgcaattactccggtctggggacattgcgtcgttggcagagtgtccgacgaggagaggaaaaatgggtattcccgttccaagagaatgcacacgtcatgttcaatagtgccatgctctacgagttggctgttttgcgtgcttacgcggagccgatcttacaggcaatccctcgtaacgaaccggaatatgctgaagcccgtagactgctacgctttttgagcagtttccgcatgataccggcacgtttgcttccgaacaactctctgatgcgtgagttcctcggaggaagcacattccactactgatgccgaatcagtccgtaatagcaggaacaaaccgagacttgggtaacatttgaagacgccggctgagtcatatctcggcatattttcagcaaaggaaacgacgtaatcgggctatataaccgacctcaattctcaagaatacgaactnagagcgaaagcctttttggttcgtaattttgtttggaccccctgatcgagtgttccgaatcggactcgtcgggaaggagctttttttgctactttttgca

SEQ ID NO: 537 - DNA (genomic), 340 bp, PORYPHYROMONAS GINGIVALIS; double-stranded, circular
  misc_feature 1...340
  hypothetical: NO
  anti-sense: UNKNOWN
actgcccggagccatgatcgcccttcgaaagtgaagggcggttgcgaagccggtaagaagctgatgaacaacctgcacctctgctccctcgccgtgagcttgggcgatacggaaaccctcatccagcatccggccagcatgacccactcgccctacacacccgaagagcgtgctgccagcgacatatccgaaggactggtacgcctgtccgtgggtctggagaacgtggaggacatcatcgccgacctcaagcacggtctggacagctgatctaaacacccaagctgataaggctgacaaaagacatatgaaccccgaaagtcgcgacgacttcgggtcg

SEQ ID NO: 538 - DNA (genomic), 1268 bp, PORYPHYROMONAS GINGIVALIS; double-stranded, circular
  misc_feature 1...1268
  hypothetical: NO
  anti-sense: UNKNOWN
gttctgggacggaatggccgatatggatggacatggagtgtttacgaagttgcttgacgatcgcaatcgcgccggcaactttgtgctgaacatgggttttcatcaggatgcatcaggccttttggcgttttacgacaaggctctttacgaacgcttcgctattccggcgggcatgactgtcgctgccgagctgaagatcagacgaggagtgtacagcggtcaagtaaagctgacagagcgttccggcagcgtccgtatcgatggcgactatctgatgggtacggataagtatcggctcgatatgcaggtggacggtctgaatttcagtgccttcatgccgaaggatagtatcggttccatgcaggcagtgcttcatgccgaagggcgtggattcgatcttttcaataaacgtactgtctccaccatacacacatcggtcaaacacatccgttggaaagaacgagatttggacagtatcactttcgatgcggcattgaacgaaggagtgctcttcgcttcattcaatagcaccaactccttcctgaacgggagtatgcaattggatgccctccttggcaaaaacaaactggacggctctgtgatggtgcggatggattcggcggatttcaatgcattgggctttgcagacaccacttttgcggcagcttttgtccttgagggtcatgtgaaaagcgatttggctcagacacatcggttcgaagcctcggtacgcgattgttacatgcagctcgaacgctataaagtaataccggagcgaatagatatattagccgataccgatcccgatagcatccgtctggatctcgtgtcgggcgacttgaaaatggctctcagagtgggagaaggcatagatgccgttacggtcgtgtcccaatctctcgggaagaagatagagatattccgcaacgactctattcagcgtctgcgactctcttcgatttttcaagagctgcctcatgcgacctttaccttgcaagccgatcgctacaatccgctccacgacttgatggaagtaaacggtatgaaatacaactccatccgtggcaagctgacagtttcgcccgaaaacggggtggaggggtatatggatttgcagggtttgcagcgcgatacgctccgcgtcgatcgtttacatctggacattgctacgctctcacaatacgggatgttcgcgccggattcagccaattcggcagaggtggcggattcgattttgaacaagtatgatcgcatgatccgactcacac

SEQ ID NO: 539 - DNA (genomic), 607 bp, PORYPHYROMONAS GINGIVALIS; double-stranded, circular
  misc_feature 1...607
  hypothetical: NO
  anti-sense: UNKNOWN
actctagaggatccccgattccatttccttcaacaaccagaacatatgtgcccggagcctgagaatacacatccatactgaagacactcgtccctgctactaattccttggtcattgcagcgacttcttctcctgcggtgttataaagctttatccgatatgtgccggcaatattcaaacttaccgaaacagccagttctgaacgaccggcgttgaaccatgcacgaagagctttggcagctccggtcacagtacatgtattggtttcgttcatacacgtaaacttgaaaggatcaggttcgccgataaagggataagtctctttgcgaaccactattgtcagcggcagagatatagtattctaccttatcattcttgttaagacctgtaaagctataagtatagtgacctgttgattccatcgtcatatcagcagccttaaagctaccggaaccattgatacgatagtaacattgtaccggcgagatagtagcattggcgcatgagacgacatctgcttcgatcttataatcagggcctgcctgttcgcccagtatcgggtagtgcttgatatagagatagcccttatccgctacctcgtgagtac

SEQ ID NO: 540 - DNA (genomic), 1079 bp, PORYPHYROMONAS GINGIVALIS; double-stranded, circular
  misc_feature 1...1079
  hypothetical: NO
  anti-sense: UNKNOWN
cgtcctactcaaagctacttatctgcttgccgccggcaacctctaccgcttgacctataaaatatatcccgatggtgtggtgaaatgtgaaaggtgcaattctcttcgacagatatggagaccgacgaatacgaatggtccgaagctgcccgaaccgctacattctcccccggcagagaagctctgcgcaaggaagcttctatcctcgaagtgcctcgtataggtgtacgcttccgccttcctgcggagatgaatgaggtacgatacttcggaagagggccggatgagaactatatcgaccgcaactacggggcgactgtcggtctgtacaccactgctgccgataagatgtactacaactatgtgcgtccgcaagagaacgggcatcgtaccgatacgcgttggctgatgctgcacggacgaggcttgggcttgggcatagtagccgacgaaacgatcggcttcaatgctcttcgacaagctgtcgaggacttcgactcagaagaagccaagcacagaccctaccagtggaacaactattcacagaccgagatacaaaaccgagatgagagcaaagctcgcaacgtcctccgtcggcagcatcatgtcaatgatgtgcctgtgcgcgacttcgtagaggtgtgcgtggatatgaaacaacaaggagtaggaggatacgatagctggtcggctcttcccgaaccttggcaccgcctaccgtccaatcgggaatacagttggggctttacccttcttccggtacgatcagtcggccaaatggccactgccacccgatacgtactactaagcacagggcgatagatgtggcaaacaccatgaggtgccaacgacactcatatatcttatacggataaaatacagcataacgcatgaagcaactgaatgaaatagtagcacatttccacaccgagggaagcgtggcagagatcgcacccttaggtgccggtcttatcaatgacacttacaaggtggcaacagccgaagccgatgcacctgactacgttttgcaacgaatcaatcacaccatattcaaagatgtggaaatgctacaggccaat

SEQ ID NO: 541 - DNA (genomic), 578 bp, PORYPHYROMONAS GINGIVALIS; double-stranded, circular
  misc_feature 1...578
  hypothetical: NO
  anti-sense: UNKNOWN
atcgccttgctccccgtgtatgcaccttgtgcgccacgctgtgccgtctgattcacattgcgtccatacgagccgataccgcctccggctccaataatccatccggctgccatcggcacacaatagcagccaataataccaatgaggagaaatttgctcgaatgaagccgcaaaaccaatttaatgcatcggccccgggggcagcctgtcagggcgatcgcgtttgaaaatttttagtctctttcctctatgatttgaatctctgacatatggattcgcacttgttttgaaaattgaatgtagcaatcatgagctttagatgtacgttagtggctgaaatgcgattgtcctgcctatgtcattgcagaagacatgaggggtagagatgcagacgtgagaaatagagcggactgtaagccccatgcacagcccggcagttgtcagtcgggatagttcaggttctcctccgtcgctacatcgagtacctcacgcaggtatttctcggcctcatatttggccatcggcaggttgtgcagcaggcagttgccacagtcgcgcggctccgtacccggcacttc

SEQ ID NO: 542 - DNA (genomic), 455 bp, PORYPHYROMONAS GINGIVALIS; double-stranded, circular
  misc_feature 1...455
  hypothetical: NO
  anti-sense: UNKNOWN
ggcaaagtcgcacgtggcagtaatccaaatgggcatatgcttataattgaatttgtgtatatcgttgagcgtcagcaaatgctcgtccgaccatccggcaggaccgccatgaccagcataattaagcaggataatacccgactgaagggtttccagcatctttttctttgcacccggaatgctgtgcaacccgttctcgatgacatgcggatatacgtcctgaaaggcgcgtaccggcatgatggcaggagcataacgcttgacggtatcgatcaaacgggaagtctcggttgcgtgcttgtccccgttgtctgccgcaaaacaggcacgaatacgccaggcaccactctctcgatcctcctcatatcggatggtcttgtccactgcgatgcgagcttcggccggagtacgtacggggaatcgccctacagccatattataatgcgccaaccgat

SEQ ID NO: 543 - DNA (genomic), 6496 bp, PORYPHYROMONAS GINGIVALIS; double-stranded, circular
  misc_feature 1...6496
  hypothetical: NO
  anti-sense: UNKNOWN
ctcggtcgcgctcctgtggccaacctgtgtggcatccgcggtgctgtatggtcggaatggctgatgaacgggctgttcggattcggaacgctcttcctccttttctgcgttttttcgctatcgctcaagcttatgggtgtcgtcaaacgtatatctgtcgtgaaacggctgatattctgcggtgtgatgaccttttggacgagccttgcagctgcattcatctacaaactttcaggtctcgaaggttttcttcgttggggcggtatgcacggtcaagaatggacactgtttctcgaacgcaatataggtaaggccggactgatcatagttctgctcgtccttgccgtcatcatagcggtagtggtacgcagcgaatgtatgggtttcttccgccgtttgctgggactaagctggatctctattcccaaactgccgaagaaagagaggaaaaataatcatgacgagtccgaaaacgagtcgctcggcaatggctacgacacgggtgaaagcgagaatctctccggctatctcaacaattcggaatacgaagacggccccgcaggcgaaagtgctgatgatccggatgattatattccacctcataaggaagaaggggaaaatgattcttcgcagtccatacagatgggatcgatgactgtggaactggctcaagaggaagaaaaggcggacgaagctctgttggcggaaatcaaaacggatcccagaatggacttggcttcatacaaatttccttcggtcgatctgcttacccagtacgatctgcagcaacccccgatcgacatgaatgagatagaagagaaccaaaagcgaatcatcgccacgctggacagcttcaagattcatgtgacaccgatcaaggctacagtaggccctacggtaacgctctatgaggttgcaccggattcgggtatcaaaatcagccgcattcgcaatcttgaggacgacatcgccatgagtctcaaggctgtaggaggcatccgtatcattgcgccgatgccgggcaaagggacgatcggtatagaagtgcccaatcgaaagccacagaccgtgagtatgtattcagtcttgacttccaagaaataccaagagtccgacatggatctgcctgtggcactcggcaagacgatcacgaacgaagtgttcatcttcgacctttgcaagatgcctcacctcctgatagcaggtgctacgggacaagggaaatccgtgggtctgaatgccatgatcacctccctcttgtacaagaagcatccggccgaactgaagttcgtactcgtagacccgaagatgctggagttcgccgtctacgaagccatcgaacgtcactatctggccaagcttcccgacgaggacagagccatcgtgacggatatgaccaaggtggtacccactctgaactctctctgcatcgaaatggacaatcgctaccgcatgctgacggaagcacgggttcggaacatcaaggaatacaacgatcagattatcagtggcaagctcagccgcttgcacggtcataaattcctgccctatatcgtgctgatcgtcgatgagtttgccgatctgatcatgacatcgggtaaggaggtagaacgtccgattacccgcatcgcccagaaagcgcgtgccgcaggtattcacatggtggtagccacccaacggccctccacggacatcatcaccggtatcatcaaagcgaactttcctgctcgtatcgccttcaaagtattctccatgatcgactcccgaaccattctggatcaaccgggagccaatcagctcgtcggccgtggagatatgcttttctatcagggaaaagacacggtacgtctgcaatgcgctttcctcgatactccggagtgcgaagccgtcactcaccacatttcgctacaggaaagctatacctcggcttatgagctgccggagtatgtgcccgaaggtgaagagggaggaccgaaagcattcaatccgcaggagaaagatcctctcttcgaagaagtagcccgaatggtagtaaactcacaacagggatctacctctaatatccagagaaagttcaatatcggctacaaccgtgcagggcgattgatggaccaactggaaggtgccggtatcgtttcgccgcaggacggtagcaaaccgagacaggtattgatccaagacgaaatgagtctggaacgcctgttcgaaacactccgataatccgaaagaaacaatgaaaacatccttgcaccggatccggatgttccggatcctctttctgcttcttttcattcctgctacgggtttggcccaacgcacagcacaaggcgaactgcaagcagcagccaagcaccttgcaaaccccgatggaacacgaatagactttcaggcagaaaccatagctcccaacgacatgggctcatcacccctctcttccggtagcctcatcctcaaagacaatcagtttcggctcagcttcggctctatcacagccgtattcgatggcaagaaaacgctctcttactacgatgcttccgagaacacgctcaacatttcccacccgacgaatgcggaattggctatgatcaacccgctgatcattctcacccgatccgaagccggctatcgcacagccatgctgcctccgacgaaaggagaaaaggtgatcggtctcacgcctaaaacggttaacggcatcaaacaaatcgagctacaggtcgattctcgggactcacgtccgaccggtgccatgattactctggaagatgggacaaagatcgttacaaaaatcaccggtatcagtcgcacgaaagcttctcccggcctgttccgactcatgaagaaagactatccgggcgtagaagttgtcgatctccgataataaaaaccgatcttagtccgtttcctctttgatagaaagaggttattaacgaacaacgaaaaactatgaaccaaacaacgaaaacactgtcgatcattcttatcggtatgctgaccttccttgtcggggcagcgcaaaactcaacgcccccccttgtagggacgtgctggaggaggtacctttctcccgaagaaatcaacctttcggcagacaacgtcagcccttctttcaaagcctatattgaattggcattcaacgaaggaaacaaagccatgctcaccatccgaatagaagggatggggacaaaaccggcagaatcgaaagaggaaatcgactacgaatgcaacggtgacgatgaggttgtcatcatcaccagacgagacgggggtggagaaaatagagagaaagctgccatcagctggacggacgaaacgatgaagttagtcaccgaaggagaagaacagatcttcaagctcatcaggaaaaagtaatcccaccaccccccactatctcttccgttcggaatggaagcagataggaaaagaggatatgctccatgcaccgagtgccggcatatcctcttttctttttcagctattgctgctgatgaaacagcgtcccccgtcagtctaacctgcgagagccatcgctgataacgacattgtacaccttgggttcgcggccgaatcgttccttgaatctcttcttggcattctcgacaaagagatcgtacagttctttcttgacgaggttgatcgtacaaccgccaaatccgccacccatgacgcgcgaaccggtcacgccacaatcccgtgctatgccgttgaggaagtcgagctcttcgcagctcacctcatagagacgactcataccatcgtgcgtttcgtatattttctgtcctacggtttcgtagtcgtcgcgctccagtgcatcgcacacatcgagcactcgctgcacttcttcgacgacatactcggcacgcatataatcctcggcagagacttcgcccttcacctcttccaacatactcatcgaagcatctcgcaggaactccacttcgggatgttttttcttaatctccttgaccacattttcgcaggactctctccgtttattatacgctgaggaagcaagttcatgctttacgaccgaatccaaaagcaccagcctgtacccttggggatggaatggaaaatatttatgttcgagcgtcttgcaatccaaacggatgagatggtctttcttcccgaaaagactggcaaactgatccatgatgccgcacttcacacccacgtacttatgctccgtagcctgaccgaccttggctaattcgaattgtcgatcataccgttgccgaagagttcgttcagggcaaaagcataggtgctttccaaggctgccgaagaggacatgccggctccgagcggaatatccccggagaaggccgtattgaatccctttacctctacgcctcgggctatcatctcgcgacaaacgccatagatatactttgcccaagtggtacggggagcatcgtccggcccgagcccgaactccacatagtccttgaggtcgatcgaatatgcccttaccttgtccgaaccattcggttttatttcggccatgacgcccttgtctatagcaccggggaagacgaaaccgccgttgtagtccgtgtgttcgccgatcagattgatgcgcccgggagaagtgaagatctgacccgtagatccgtcaaagtgcttgatgaatctactccttacgaagtctaattccataatttctgcttgtttatgattggtttgatacaaaatccttgtgagaagatcactcgacgataccgaatcggaacgccgtccgggactcgaacacttcgcccgggcgcaagagggtcgtaggataattcggtttgttcggcgaatcgggatagtgctgcgtctcgaaacaaacggccgagcgagccggataacgccgatcggacttccccctcagctttccgctcatccagttgcccgtgtacacctgcatacccggttcggtggaatagacatccaatacgattccggtcttgggcgatacgcaacggccgcaaaagccatatgcccccgacggcttgtccacgataaaggtatgatcgtatccctttgcccaaatgagctgatccatcgcactgtcgatccgatcccctatgccgtgaggcgtgaggaaatcgaacggcgtcccctcgacctcggcaggctcgccgtaagggatggccgtatcgtctgtggggagataatgccgggcttgtatcatgagggtatgatcatgcacggagggatcgcctgcacccgagagattgaaataggagtgattggtcagattcagaaccgtaggagcatccgcagtagcacgatagtctatgtgcaatgcgccctcatccgtgacgctgtaaatgatccgaacgaccagctcgcccggatacccctcctctccatctgccgacacgtattccagcacaagcgaagaggggccggcggatttcacctcccagaccttcgtattaaatccgctgatgccgccatgcagagagttcggcccattgttgatcggcaggctgtagcatctgccgtctatggagaaagaaccgcgggcaatcctgttggcatacctgccgcagacggcaccgaaatactgctcctccgagtcgatgtattcctgtagggagtcgtgccccaggacgacgtccgtccgattgccatctttgtccggcacgatgagggcaacgattcgagcaccgtagttggtaatataagcgtctattccttttccattggtcaaatggtagagatccacatccttaccattcaggcaggaggcaaaggaggatcgttgcggaaggctgatctgattcattttgcagtctgttttttagaaccttccaaatatagacattccacagctaagtaaatgctccgcctttgatgggacagtcgtatctgcaatacctgtttgagtctccatagagcatcgagacaaacaataacctccccaaaaagaaaagggggggccgaccacatgccggctccccctgcttttcccttatcagggtcttgttttcttagaaatgaacattgaatgtagccaaggctgcaaaaacttcgcccccgaattcatatgtcgcagtagctcctgccccaagggtattggagatgcgatattcgtaggccatgcgagcaccaaggctaaatttgccattggcatacgtgcgtgccatagcatgcttattgtctacatccatatataaataattattgtttttataagaaagacctgcctgaccggctaaaaccaaatcatgacggctgttcttccaaatcagcttgatggggctgaaaccggcaacggccataaaggaggtagaacttccagaattaagacttttccaagtggcatcctcatactgcgcaacttccagataatggtatggaagagcagttgcctccgcataggagaatccatattgagactgttgcgggggagtttcattgagctcttttgctgcagagctgattcttagtgtcttcgggaaaggtcaaacctccggtatatggacatcgagcaaacagaaatttc

SEQ ID NO: 544 - DNA (genomic), 503 bp, PORYPHYROMONAS GINGIVALIS; double-stranded, circular
  misc_feature 1...503
  hypothetical: NO
  anti-sense: UNKNOWN
cgcgaatcggagggtaagatgcaggagtccatcaaccacgctgagggagaggagcaggccaagattctcagagccaaagctgaggcagaggctaagatattggtggccaaggcagaggccgaagctatccgccagatcagcgaagcagtagccggtagtggtgccaatccgacccaatacctcattgccatgcagtatatcgaaacgctcaaggacatcaacaagggcgatcagaccaagaccgtttacctcccgttcgaggctaccggtatgctcggtgccttgggcggtatgaaggatttggtgaaaggatgagactctctgccattcttatcgctttgattgtgatgctgcctgctgtgcttagcgggcagcattattattccatggcgggagagcgactggagacggacagcattcgtccgaacgaactctcggcatcgatccgaagtgcgcttttctttcggaacaatgaataccaatgcacgttcggtcaaaaggtt

SEQ ID NO: 545 - DNA (genomic), 5633 bp, PORYPHYROMONAS GINGIVALIS; double-stranded, circular
  misc_feature 1...5633
  hypothetical: NO
  anti-sense: UNKNOWN
gctgctgtccgcacaccggcaatgatgattttgtgcataaagatttcttgccgcaggcctgcagcaaggagtctaccgcgggagattatcaaatgaataaaagtgactgtttgttgtgcaaaggtctcaaaaagggaaaatggctcgtaaaaaccggtgcttgtggtactgaaaaacgtggcgcgagaattttttcgttttggttcgggaatgaaaaaaatctcgcgccaaaaggaaaaagttttggcacgtgttttcagaaactgtggttcggcgattcgagtatttgcggctcgtgtttttcacgtttggggaatgcgcatcaggagccaaagggaattgaaaggaatggaactggctttagtttcgtatttttgcacggatatgggacgaatactggctatcgactacggacgcaaaaggacgggacttgccgtcaccgacccactgaaaatcattccgggcggactgaccactgtacctacccatacgctgctggacttcctgcgggactacgtcagccgggagccggtggagcgtttcgtgctgggactgccacgccggatgaactacgaagagtccgaatcgatgacctatatccgccccttcgccgttaaacttgcccaagccttcccctctatacctataacgtacgtggacgaacgcttcacctcgcgcatggcacagaggactattctggaagccgggataggcaagatgaaacggcgagacaaggctctggtggatgaggtcagtgcggtcatcatcctacagtcgtatctggacaatcccgacagatgagcgagacggcttattccccctgcttcgagacggggacggcattttccacccaaaagacaagagaaaagacaatcacaagaacacaaatactattcgatagaacaatgctccttcctatctacctatacggacatccggtgctgagaaaagtagcagaagatataactccggactatcccaaactgaaagagctgatagccaacatgacggagagcatgtaccactccgacggcattggcctggcagctcctcaaataggcttacccatcagggtactcgtgatcgatgccgatccgctgaaagaggattatcccgaatgtgccggattcaagcgcgtgatgatcaacgcccatatcgaagagcgaggcgaagatctctgcaccgaatacgaaggttgcctcagccttccggccatacacgagaaggtggaacgccccacctccatccgtattcgctatgtggacgaggactttcagccgcacgaagaggtgctccagggctttgcggcaagagtggtacagcacgaatacgaccatatcgacgggaagctcttcatcgaccacatcagtccgatacgcaagcagctgatcaaagggaagctgcagaatatcatcaaaggcaaagtacggacttcgtaccgcgtagtgacagctccgaccggcaaaaaacggtaagccgtagtcaaatccatttctccccggctctgattatgacattcaaacgctccttattcttcctcctgctcctgctctccgtggccacagctcgggcgcagatagacgtcgatcgggtgatcacgatcgggcgcaatgctctctacttcaacgactacgtggtgagcatcgggtacttcaaccaagtggtaggcctgcgcccgtggatggcggaaccttatttctatcggggaatagccaaaatcagtctggaagactatacaggggcggaagccgatgcttcggcctgcctgcagcgcaatgcgctcatccccaaagcatatcttcttcggggcgtggcacggcagaatctgggcaaaatcgattcagccattcaggactaccgtcgcggattggagctgatgccgaacgatgagggcatgctggtgaatctgaccggagtgctcaccgacagcaaacgctatgccgaagcacgggaaggggtagccgaactgctcaaattctaccccaaaagcaagcaagcacatatagctctcagcgcgatagagctgggcgagcaggataccgtcgcagccattcgcgaactgaacgaggtacttcggatggactctctctttgctcctgcctattcgcagatggccatgctgcacctcaagagcaagcgcaacgcagaggctatggcagccctggacaaagcaatagaattggagccgagcgaactgtccaactatatcaaccgcggtgtcatccgctaccaatcgaacgacttgcgtggagccatggacgactacagccacgtcgttcgccaaaagccgaacgacaagttggcacgtttcaaccgtgccttgctccgctcttacctcggtgacgtgaacaatgccatcgaggacttcgatgtagtcatccgtctggagccggagaactatcatgcactctacaaccgtgccatcctcctcacgcagatcaacgagaaccgaaaagccattaccgacttcgacaaagtgctgggacactatcctgactttgtcgtcggctactatgctcgctcccaagccaaaaaggcattgggcgacactcgcggagccgaacgggactactggcgcgctttcgacatagaaaaagcggcacagagcaagacaaaaaaaacgaaaaaaagcagctcttcgacttcgaccaaagagacacgtgaggatagcgacgaaacgatagagaagttcaacctgctcgtcgtatccgagaaatcctccgagaagcgcacacgctactccagtcggatacgtgggcggattcaggacaacgatgtagaggtacagccctcgccgctattcgtcctcagctactacgagcagtcctcttccgaagaggtgccgcgcgtctactactcggaagccattgctcgcttcaacgacaaaaaggttctgcccaagcgactcaaaccgatcaaccgtgaggtagctctgagtcaagagcaggtggcatatcacgaacaggacataacggaaatatccgagaggactgccggcaatgcagatctgtgcttccgtcgcgctttggactatatgctgatacagaatttggagcaggccatcgtcgatttcgatcaggctgtagagctgaacaagcagtttgccctcgcatacttcggaagagccattgcacgtgccaagctggtcgaggcccgtcagggagcctcctttatccaccaagaggccgaaacggtgaatgccatgacaaaagctctgatcacgacaccgcgaaccaatgcaatgggagtgccggcggctgccgaatcccccgagcgtaagcctgccatatcggatgtggacggtgagctggtgatgcgcgacctgaaccgcacgatcgagctggatccgaattttgcctatgcctactacaatcgtgccgtgctactggccagacgaggcgatacggatgctgccctgtcggactacgaccgtgccatcaaagcctatccggagtttgccgatgcctatttcaatcgcggcctgctgttgctttcgcgcggaaaggccaaagaaggcatcgccgatctgagtcgggcaggcgaatacgggctctacaaggcgtacaacatcatcaaacgaatgagcacgaagtcatgatctccgtcaataacctgactgtcgatttcggcacccgtctgctcttcgatcaggtatcattcgtcatcaacaggcgcgaccgtatcgctcttgtagggaagaacggtgccggcaagagtacgctgctcaagctgattgccggcatggaagaaccgacatccggacacatagcacgccccaaggggatccgcataggctatctgccgcaggtgatgcgtttgcaggacggacacacggtttacgaagaggtcgagcaggctttcaacgatattcgccaaatagaggaagagatacggcgtctgtccgatgaaatggccggacgtacggactacgaatcggatgactatatccgactgatagagcattatacgaatatgagcgagaccctctctctcatgcagcagggcaactatcatgctgcgatcgaacagacattgatcggtctgggcttcggccgagaggacttccaccgccccacagccgatttcagcggaggatggcgtatgcggatagagctggccaaacttctgctccaacgccccgaagttttgctgctcgacgagccgaccaatcacctcgacatcgaatccatcggctggctggagcagttcatcgccaccaatgcaggagccgttatcctggtgtcgcacgacagggcattcatcgacaataccacgacacgcactatcgaaatagaactgggacatatatacgactacaagaccaactacagccactatgtggagctgcgcgaagagcggctgcgacagcagatgcgtgcctacgagaatcagcagaagatgatccgcgatacggaggacttcatcgaacgattcagatacaaggccacgaagtccgtacaggtacagagccggatcaaacagttggagaaagtagagcgcgtggagatagacgagcgggatcgttcggcatttcacttccgctttatcccggcacagccttccggcagttatccgctaatagtggatgatttggccaaggcttatggcgatcaccaggtgttttccggagctacatacaccatcgaaagaggcgaaaaggtggctttcgtaggcaaaaacggtgccggcaaaagtaccatggtcaagtgtatcatgggagagctgacagactacaccggcaagctcgaactggggcacaacgtgcagctgggctactttgcccaaaacgaagcccaagagctaagaggggatctcacggtattcgacacgatagaccgtgaggccgtgggcgacatccgtctgcgcctgaacgatttgctcggggcttttctcttcgggggcgaagcatcggaaaagaaagtaagtgtcctgagtggaggagaacgagcacgattggctattatcaggcttttgctacagccggctaacttccttattctcgatgagccgaccaatcacctcgatatgcgctcgaaggatgtactgaaagaggcgatcaagaacttcgatgggactgtcatcgtagtatctcacgaccgtgagttcctcgatgggcttgtcagcaaggtgtatgaatttgcagatggacaggtgaacgaacacctcggaggtatatacgactatctccggacccgccgtatgcagacgctgacagagctggagcgaaccactacgatcgaaacaaaaaccacacgggaggctatacctgaaacggaagccaaagcggactaccgtcggcaaaaggaggtagccaaacagctgcgcacgttggagcgaaccgtagcaacctgcgaggagcggatcggaaaattggagtcggaattacaggcaatagagatgctactgcaagatccgaaacatgcgactgacgcgaatctgttcgagcgatacgccggcatgaaacaagaactcgaaaaggccatggaggactgggaacaggcttccgaagctttatccgaagcccaaggataagctcaacctcccccctctcttctctcctcctttaccaagagaccatctcaccaccaatctattagaagctgagacaacctttcgccatccgtccgaaagcc

SEQ ID NO: 546 - DNA (genomic), 595 bp, PORYPHYROMONAS GINGIVALIS; double-stranded, circular
  misc_feature 1...595
  hypothetical: NO
  anti-sense: UNKNOWN
ggatacgtccggagaaggtggcagcagtggtaagcagggcagctccgatgtattcacctcgaaacggaacgagggtgcccccctgtgggtgcaccctcgtttgtacaggccggactgatccggcttagagaattgtctccagttgatcgggattcggatctactgcccgtataatcccatgtgcgtccaccaggtaactgtggaaacggatcttcaagccatagatgttgagcatttgatcgcgtttactattttccaccagtcgctgggcagacaagtctatttggtcgaaagccaaggtatttgtgaataccgacaggtttttgtccatcgaaacacctacataccgtacccgactgtcgggtcttttggcaaaataacgagaccatcggacattaccggccctgctctctccatcgtatgccgcccagaagtggatcagcgtgtacgaagcagcctctgggctgccgtccgattgtacgaccaaagactttacctccggcaccgctgcccctactgccaagccatctatggcttcggatggagaggtggccgagctacccgacaaaagcaaggcagccgcgaccaatgagcc

SEQ ID NO: 547 - DNA (genomic), 784 bp, PORYPHYROMONAS GINGIVALIS; double-stranded, circular
  misc_feature 1...784
  hypothetical: NO
  anti-sense: UNKNOWN
ggacgatccctcctccctgtgnaattgagaaaccgtacacggctaccgatggtgatattatttgtactcattgttctaaataagtggtattcataatttgtactccacaaaaatacaaaagaacgagcggtgtatcaaagggataaaaagaaggtgtgcaaaaatcgcctaattgcgatttcgacacaccctctttccataatcgatttaattattgtctttcgctaaccgtcgaatcagctcagtttgtggatgattagaccggaacgaagtttcggctcgaaccaagtagtcttgggaggcatgatattgcccgaatcagcaatgtccatcagctgtttcatcgataccggataaagagcgagagcaacacgcatttcgccactgtctacacgctttttcagttctcccagtccgcgaataccacccacgaagtcgatacgcttgtcggagcggagatctttgatgcctaagatctcatccagaatcagattcgaagagatcgtaacatccagtacaccgataggatcgttgtcatcataggtgccggcttttgctgtcagcgaataccatttgccaccgagatagagagagaagttgtgcagcttggaggggcgatattcttccgtccctttgcattctacttcgaagtgtcgagacagtttctgcaagaattcttcatcactcaagccattcagatctttcactacccggttatagtcgatgattgtgagctgatcggcagggaagcatacagccatgaagtagttggactcttcatcgc

SEQ ID NO: 548 - DNA (genomic), 440 bp, PORYPHYROMONAS GINGIVALIS; double-stranded, circular
  misc_feature 1...440
  hypothetical: NO
  anti-sense: UNKNOWN
gcatcgttgtccacggaggcgggccattgacaggaacaaataccctgttgttcagaatcagagagttcgtgtacggttgttcattggtggccaaagcgcgatatacctcgtacttcgttccccatgcgcaggtctgtgctgcgaagtaggctgccatatcttccagggcttggtgctgagggtgattgtcaggcactttcctgatgaggattttgttcggtgccaaatacttgccccaacagtccacatggttgatatattcgccgttcggatcttgtaccacatcatgatgtgtgatgccgagatagctttcatcttttgattacttgagcttgagacagagaggagttctccgtatatgcgatatgtgactgcacagcggatccatatccgtccgtcatgtagttgccaccggtctgcttgagcttcatcccgaacat

SEQ ID NO: 549 - DNA (genomic), 573 bp, PORYPHYROMONAS GINGIVALIS; double-stranded, circular
  misc_feature 1...573
  hypothetical: NO
  anti-sense: UNKNOWN
ggttaccaatctcaccggaactgcttccaatgacgaagtttctttggactgggacggtgtggaagagaaagctgaagagccggcaagtgataaagcagtcagctacaacgtctacaagaatggaaccttgatcggtaatacagctgaaactcattatgtggagaccggtgtagccaatggtacatacatctacgaagtggaagtaaagtatcctgacggtgtatctccgaaggtggctgtaaccgtgaccgtgaccaacagctcattgagcaatgtagatggacaggctccttacacattgcgagtagaaggcaagaagattattgcggaagcccatggtatgatcacgctctacgacatcaacggacgtaccgtggccgtagccccgaatcgattggaatacatggcgcaaaccggtttctatgcagtgcgcttcgatgtggggaataaacaccatgtatcgaaaatacaagtaagataaagcagatactttcccctgactaaagacaaagaggctgcgtcgagattatttttcgatgcagcctcttctttttgctactcatgcccgtattg

SEQ ID NO: 550 - DNA (genomic), 428 bp, PORYPHYROMONAS GINGIVALIS; double-stranded, circular
  misc_feature 1...428
  hypothetical: NO
  anti-sense: UNKNOWN
aggcaatagacatagccgatagtatgttgaggaaagcaaaggaagagaaagaggaaaaggaaaagaagaaagataccgtagctatatccatacagaaacacagtgggcagaagatagagttcctactgccgtgtaagcatagtaccgataagtgtaaacaagaaacaggcctatacaaaaaggcaaccgagcttatacgagcttttaaggaagatgacagtatgctcaacagtcttatctattggatagaagattgttgagacaattttcaccgacgaggtaccctataccaagagcgatcaatgcggcttgacaactttcgacgaagatcacaggagaacgaagtgtttcgactctgaagaagtatccactccatgcatcactccgaagatcccccgcagttgaagacaaagaactactgcacgcat

SEQ ID NO: 551 - DNA (genomic), 407 bp, PORYPHYROMONAS GINGIVALIS; double-stranded, circular
  misc_feature 1...407
  hypothetical: NO
  anti-sense: UNKNOWN
gctcctgccgtaatgagctttctggagcagcacaacctcaaaggcaagaccatcatcccctttgtcacacacggcggtggtggcatgggcaagtgtttggacgaaatgaagcgactggcacctcaagcgacaatcctcgacggcatcgttatcgacggcaagaaagccaaagaatcggccgaagaagtccacaacagcctgaaagcgatgggacaaatcaaataacgacaaccatccctactccagaccactgaggaatgatagaggcaagctttcccccacaaatcaaacacaagctccctaccctccccggttcttttcccccacaaaaagaggcgccatccgacgcctcttttttatacccaataaccaccaaatacgcaccaaaaaacttttcaacaacgaag

SEQ ID NO: 552 - DNA (genomic), 624 bp, PORYPHYROMONAS GINGIVALIS; double-stranded, circular
  misc_feature 1...624
  hypothetical: NO
  anti-sense: UNKNOWN
acgacctccggtacgatggcgcacccatgcatatcaggcggttttccaatttgcccgttttggggggcgagtcctgccggttcgttatcagtgaggtgccggagtctctggtggttttgcaggccaattcttccctgacagcatcgcttgttcccgttaagactgtcggggataagaccattgagttcgtggctccgccgaagggtcaggatcgtaggactatcaatacgttttatgccgtggacttgtcacaggcttctgctccggagatcctcggagcggtacccaatcaaaacctgcatggagaggaaatccctgatctgatcattgtctctactcaggcgctcctccttgaggctgatcgactggccacctatcgtagagagaaaaacgggctgaaggttttggtcgtgttgcaggaacaggtgttcaacgagttttcgggtggaactcccgatgctacagcataccgcctctttgccaaaatgttctacgacagatggaaggcaaatgcacctgtgggagagaccttcccgatgcaaatgcttctcttcggtgatgggctcatgacaacaggaaggtctccgtagcttggcagaaaccgtatctccaacaaacggagtc

SEQ ID NO: 553 - DNA (genomic), 587 bp, PORYPHYROMONAS GINGIVALIS; double-stranded, circular
  misc_feature 1...587
  hypothetical: NO
  anti-sense: UNKNOWN
gtcagtgctctccccagtgtattccttttggtcaggatttgatcggttaactcgattggattttgaccgttttcctcatatctaagatcaaaattaaacttgatggggtgcttcataagttcatctccatcggatgaaactcgtctgcgaaaatccttagcttcgggggtcaactgtgtccatgtaggtgtgtgatccatcttgaaaccacaaaagaatgtgcctaggacatactgacaagccttaagaacagacgttttcccactgccattgtcgcctattaaaaggttgactcctggcagaaaaaatagctccaagtcaccaatatctctaaactcttcgatgtgaattctactaatcataacctacatatattacaactagacaaatatatatataaactcgagacctttgaaaaataaggaggtggaggcagggcaaccgcatcaaaatgtaagtacctgattatcaatcatagttttgagtatatncttatctttgagtataatctccgaaatgcaatcatttgaaaattagcacctggattttctcgaatttttgatgcgttgccctgtgcaaggtcttat

SEQ ID NO: 554 - DNA (genomic), 562 bp, PORYPHYROMONAS GINGIVALIS; double-stranded, circular
  misc_feature 1...562
  hypothetical: NO
  anti-sense: UNKNOWN
ggctaagaaggaagaggatacaaagggagagaagggtgacatgtttacgccggctgctgtatattcggatatggcgatagccttttcgttctcattcgctacaatggtgtagacggtgtcgtccttggacagctctatgagcaactccatcgggatgcaccgaagataagagataagaactccggcagaacgttcgaactctgctatactgcgaacggggcctgccggaggaggtgtctcgacgaagctcttgtccgtaccgttccatttcgaacctgtcgcgatgtttttgccggtgaggagtgtttgcgactgtgctgtcatcatgaggccggtgagcccccatacagcgatcatcagactctttcttaaaaatgtgttcatcatacttttttatttggaggttatgaataatggtctgtattatggtcgggaggtcattcgccaaaagtccttggtgccgtagagggtattgatccacatggcaaaaagtttgtccgtgacacaatagaccttgttgatctcggtgataatgtccttgtcgagcagtttgtttgcagcc

SEQ ID NO: 555 - DNA (genomic), 1044 bp, PORYPHYROMONAS GINGIVALIS; double-stranded, circular
  misc_feature 1...1044
  hypothetical: NO
  anti-sense: UNKNOWN
cattcttctgtttacttgcagagccatacactgctcatgatcttccctgagatgagactgttgcatggagtttcattgactctttgctgcagagctgattcttagtgcctttgggaaagatcaaacctccggtatatggacatcgagcaaacagaaatttccccaagtttccattagagaagtactcctttcctcgtcaaataggcgagaaataagaaacgattgtcggctgtttcttgcttcctgcacgatgcaggacgcgattgtcggctgattcttgcttcctgcacgatgcaggacgcgattgtcggctgattcttgcttcctgcacgatgcaggacgcgattgtcagctgattcttgcttcctgcacgatgcaggacgcgattgtcaactgattcttgcttcctgcacgatgcaggacgcgattgtcggctgattcttgcttcctgcacgatgcaggacgcgattgtcagctgattcttgcttcctgcacgatgcaggacgcgattgtcagctgattcttgcttcctgcacgatgcaggacgcgattgtcaattgattcttgcttcctgcacgatgcagggcgcaattgtcagttgattcttgcttcctgcacgatgcaggacgcgattgtcggctgattcttgcttcctgcaccgatgcaggacgcgattgtcagctgattctgctcccatcaatgcgctaactatcagctatttgcaactattttataggactttcattaaagtcttttgccgcagagctgattcttaagtgtttttcaggaaagatcaaacctcatgcataagggcaccaaacaaatagaaattacttgaggtttgcagagagatcgcatgaagctctcctttcttcgtcaaatcaatgcttgtgtctgtcttgatcgatatgaggaggtgggaggttattgtgcaacagtctctgagatacaaagaatgaacccatacgagaggatactatggtcttcggagtcgtacagctctataaccaaatccactccataaagcaaagaaagaaaggggtg

SEQ ID NO: 556 - DNA (genomic), 920 bp, PORYPHYROMONAS GINGIVALIS; double-stranded, circular
  misc_feature 1...920
  hypothetical: NO
  anti-sense: UNKNOWN
ccccggagccatgattgccgatgcggtacactcgttgtctgatctgctgaccgatttcgtggttttcatttttatctccatttcgggaaaaccatccgataagaaccacgattacggacatggtaagttcgagaccctcgccactgcgatcattgctgttacgctgatcatcatcggagctatgctctgctccgatggtctgaccaaggtatatcgctatctccgctttggggacgaattggctcgtcccggattgatagccttgcttatggcctttgtctccattgtggccaaagagtggctgttccgcataacgcgatgtgtcggaaaagaggaaaatagtcgttcagtcatagccaatgcctggcaccaccgtagtgacgcttatacctctgtggctactttcatcgggattggctgtgcttttcttttggggcgcggttggatgatcctcgaaccgctatcggctgctgtagtaagtgtctttatcatcaaggtaggttttcaaatggccgttccggctttccgcgatctgctcgaacagagcttgccggatgatattgaagaagagatagaaaaaatcatttgttcggaatcgatggtaaaaggtgttcgtcggatccgcactcgcaatatcggtaattactatgctgtcgaagccgatattttgatggatggaggcctctctgtggcactatctcatgctgctacgcagagggttgagaagctgctgcgtggacgatacggccaacccacacatatagtcatccacgtcgagccgttttcatgatatatgttgaccataaccttttcaaattctgtaaagctttatgacgactgaaatcaaattggaagaaatgcgtttttatgcccgacacggtgtgcttgagcaagagccgacaagtgggggaaccggtttg

SEQ ID NO: 557 - DNA (genomic), 457 bp, PORYPHYROMONAS GINGIVALIS; double-stranded, circular
  misc_feature 1...457
  hypothetical: NO
  anti-sense: UNKNOWN
gcaattatgcctaatctgcttggctttcatctgccttttttttctcgatagctgtggtaacaaaaatacatttcgtgtcgaagggtcgattgccggttatgaagacaccgcacaagtgtatctgaccaagatcattgggagcgatctttctgtactcgattctgtaaatcctgaccgaaaaggtcgtttcagttttgtagcacaagcggactccacaccgtctttctaccagattaaactcaggaagcaacatattaattttgccgcaaggatcggatcggaaatcaacatacaggtgggtccgtaacagcttttccgattacgttattgaagacaaccaagggcctgacaattaacaatattcgcaaggattggcgctattgaaagagcaagcggataatcgtttggatcattttgtaccgttcataccaagagaacaaactggatgcttcgcagt

SEQ ID NO: 558 - DNA (genomic), 2646 bp, PORYPHYROMONAS GINGIVALIS; double-stranded, circular
  misc_feature 1...2646
  hypothetical: NO
  anti-sense: UNKNOWN
tggatgatattgcagccggtcgcaagtacatgaaagtgtacaagcagatgaaaatgtacaacgatcccactcttaatccgattcttttgggcaagaagtagaaagcgaccgttccccgcattcatcattccttccttacggacaactgccgtttccccgttttttacctttctgtcgttctcccatggctcgatatctgatagtccgcttgtcggcaataggcgatgtggcaatgacaataccggttttgtatgcggtagccaaggcatacccacagcatagtttcacactgctgactcagcctttcctgacatcgctactaatcaaccctccgaacaatttggaagggatggggatcgacatcaagcacgaagagtcttccttggtcggtcttcttacctatatcggacgactcaaggatgagcagttcgactatgtcatcgacctacacaatgtaatacgttccaaaatcattcgcttctatcttcgctttttcggagtcaaaggtttcagtctgaagaaaccgcgactacagcttcggcagcttacggccaagccacccaaaaagccaacccgattgccttccgtaatagaacgatacgctcaggtttttcacaaagccgggcttgaaatacatcctccctaccccatccttctgaacgactccggacatatctctaccgaactgccgatagtggagataggctccggacaccacctcatcgggatagcaccgtttgccggtcatgaagccaagacatatccgccggaaaaaatgcacgaggtagtgcgtacccttgccgagagagacgatgtgcagatttttcttttcgggggtaaggggaaagaaaaaaacatactggagcagtgggcagacgaatcgccacgcatcgtatccgttgccggtctgctgtcgctgccggaagagctatctcttattcatgccttgcgctgtatggtttcaatggatagtgccaatatgcacttcgcatcattggtaggtacacgagttatctccatctggtgtgccacgcatccggcagcaggatttctcggatatggtcagcgcatagaagattgtatcggagcagacttggattgccggccttgctccgttttcggcaataaaccctgcttccgcaaggattatgcatgccgtactcagattgaacctcaacttatcattaacaaaatagtttccacacttactgatttgaattcagatgaaactgagaattaataagctgattagcgatgccggactcggctcccgccgcgaagcagagaaatacatcaccgaaggaagagtgaaaatcaatggtcgaatcgctcgcttaacggatttggtctgcgaaaaagacattgttcttcttgatgatattgacattcctatcaaggatctcattcgtgaagaaatctccctgcgcaaatatgaggaacggctcgctccctccgcctccaatcaaggcagacaggatgaaaagcgaaagaatccgcgtcctaaacaacacaaagaggttccgtcgcaacgcaatgccgggaaacctcgttccgaaagcaggattcgcaatcgttgggaagaaggtgatgaggatgattttgacttcgatacaggacgcggttttcggaaaggaaatagaaagaacgactcatctgtaaaaaaattccgacactaagcagagcctaaaaagttgaggtttagaaaaaagaaggcgcagactccttggatataggagtcttgcgcttcgcatattatttcttgtagaaatcgtatctgcggtaagactgttgcatgggagtttcattgagctcttttgctgcagagctgattcttagtgtcttcgggaaaggtcaaacctccggtatatgggtaccgagcaaatagaaatttccccaagtttccatcagagaagtactcctttcctcgtcaaataggcgagaaataagaaacgattgtcagctgtttcttgctccctgcacgatgcaggacgcgattgtcagttgattcttgctccctgcacgatgcaggacgcgattgtcagttgattcttgcttcctgcacgatgcaggacgcgattgtcagttgattcttgctccctgcacgatgcaggacgcgattgtcagttgattcttgctccctgcacgatgcaggacgcgattgtcagttgattcttgcttcctgcacgatgcaggacgcgattgtcagttgattcttgcttcctgcacgatgcaggacgcgattgtcagttgattcttgcttcctgcacgatgcaggacgcgattgtcagctgactctgctcccatcaatacgctaactatcagctgtttgcaactattttataggactttcattgaagtcttttgccgcagagctgattcttagttttttttcagatcaggcaaaaagaaagagcgaggaggtaatccaactcacaacgaatgtcagtaacagcatcaccagttctacgcgccgattgatacgaatagcaatctgcatatctgccgttgccagttcacgttcgttatggccgatataaggcttgctgatgctttctccaaaataatcatgtgtacccccgaaacggcaattcaatatacccgcaagagctgcctcgggataaccggagttaggacttgcatgttgcc

SEQ ID NO: 559 - DNA (genomic), 469 bp, PORYPHYROMONAS GINGIVALIS; double-stranded, circular
  misc_feature 1...469
  hypothetical: NO
  anti-sense: UNKNOWN
cgttcaggcgaaacgaaccgacaagaaaggacttgtgcctgtcatcgggcgcatctcagtgggcagaacccattcaggcttctccaccaagtgcaagactccgctcgctctttgggacagccgaaaacaacggctcatcggcaagagtgcaatggcggtgtccgtcaatcagaaactcggtgaatgcaccgcactcatccacgcacgctttcacgaactctgtgaaaggaaagaaatttttaccgccacagacgtgagggatgcctatcaggggcaaatccaccaccaagccctgctcttggagagtttcggagagtatctcacacagacaaaagagcgcataggtattgacagagctttgaagacgttcaaactccgtacctaccagctctccctgctccgtgagtatgtacaaaagaagcacaaggtaagagacattcccctttcacagttggataaagcctttatg

SEQ ID NO: 560 - DNA (genomic), 905 bp, PORYPHYROMONAS GINGIVALIS; double-stranded, circular
  misc_feature 1...905
  hypothetical: NO
  anti-sense: UNKNOWN
cttttggtccatacttatagatactccttaggttgcattattttttaccggtacaagccttcgaaagtattcatggtcagagcggcatataatgattaagacatataaaaataaatccatcagcaagattggccttgctgatggataattgtaggaagagacataccaagcgacgaaatcggctgcttgtctcacttggccgattttagccacgaggctcgcggtggtcacgatcaccaccacgacgttcgaagttacgacctccttcgcgtcctccttcacgccgctcacgccgctctctcggctgaggctccacgtagccttccggtttttccagtagcaccttgcggctgagtttgaacttgccggtcttcggatctatatcgagcagcttaacgttgatggattcgccttctttcaggttggtgtcctcgatggtctcgaatcgtttccaatccacttccgagatatgcagaagtccttccttgccggggaggaattcgacgaagcagccgtatggcatcacacttgtgatcttgcccggataggtttctccgacttccggcatagccacgatgcccttgatcatgccgattgcagcatcgatgcagggtttgttcgtaccactgatctcgatgacacccatgccatctacctcttcgatgttcactgtggcaccactcttctcctgtatgccttggatgatctttccgcccgggcctatgactgctccgataaactccttgccgatatgcatcttctcgatacgcggtgcatgaggcttgaggtcatctcttgtctcgggctgagcttccatgatcttgccgaggatgtgtaggcgtccttgcttggcttgctccagagcattctccaaaatctcataagctgagaccatccaccttgat

SEQ ID NO: 561 - DNA (genomic), 475 bp, PORYPHYROMONAS GINGIVALIS; double-stranded, circular
  misc_feature 1...475
  hypothetical: NO
  anti-sense: UNKNOWN
aaaaagcaaatgccggtatcacgggttcttcgttgcgggtataggatgctatgagcgaagccacaaatagcagaccatagaacaggagcaaccaatatgcccatcctttgcgccctcctatgccatagagtggaaattttttcatattcatcaggggagaatatcaatcagtttatgaatgcttgctgtgtcgagtgctgccgtcagagagaagcgcaggcgagccgtgtggagaggcacggtcggatgtcgtatcgggagtacgaagaagccattgtcctgaagatgttcggccaacgcaatgcaaggagcattttcgcctaccatatagggaatgatgtgactcgatgatggcatttctatgccttttcccttgatagcatcacgcaaaagcgtagcagaatcctccagccgctttctctccatcacaaactcaggtagccgacggaatatcagatcagtccatcctatcgta

SEQ ID NO: 562 - DNA (genomic), 274 bp, PORYPHYROMONAS GINGIVALIS; double-stranded, circular
  misc_feature 1...274
  hypothetical: NO
  anti-sense: UNKNOWN
catttttacgaactgacgtgtacggaatcggagaggtcaaaaaaagcagtaatcatgtcgaaacatttgaccgattccgagcgtcttcacattgtggaagaatacctcggcagccccggagcaagtatgccatcgagaagaagtacaacatcgcccanggggcttattagagaccattgtacggcatttttgcgatatgaccattggtcttttcttaacgtgagctcgatataaaggaatggcacaacacattggttattagtgtgttttattt

SEQ ID NO: 563 - DNA (genomic), 2613 bp, PORYPHYROMONAS GINGIVALIS; double-stranded, circular
  misc_feature 1...2613
  hypothetical: NO
  anti-sense: UNKNOWN
actaccggtggattccgttgaaactactagtagattcttccaaaaccactagtagttttgcccgaaaccactagtagttttctctgaaaccactagtggttttattacgcgttaaaagagtattgtcgtgtgccgaaaaaaagatggtagtcaggggcggttaatttcatcttggttcaacaccgtttaggagcacgactgattaggatttacacctgccttcgatgaatatcctgccgatttgcttgttttccagcatatccatatacaaaaaggccaccctttcctatgaaagagcggccgtatctgtccctgtttctaacctaacctgaaattattcggcaggatggatagcttcagaagggcatgctgcagcacaagtgccacaatcaatacatgtatcagcatcgattttatagatgctaccttcagagatagctgataccggacattcatcgatgcatgatccgcatgctacacaactgtcattaataacgtaagccatagttttgtaatagttttatggtaagacaaattttgtttatcgtatcacttttgtgaaacaaaggtagaaagaaaaccgaatataccaacatgtaggtatgcgaattttctactgcatttctattgaatagagttaacttattgattttctccgattttacgaggtttttgaagagattatgagtaataagcattcgagaaaagtagtctcgaggtgcgacttaaacgcgaatgaatacctatagagagctatatatatgcttgttgtcggcaatcatccctacataaaattggcacgagatcaggtaagaggaatgagacgaaataagctgctgtttacttttcctttagcaggacttgcttagtagagatagcggaagagaagaaagagagaagaaaatccgagaaagcacgacgaaccggtgcggaagaagaaaaatcattacccatcaatacaacgctgtaccattctccttggaatcgcacatagccggcataccctaaaacacctttcatactaccactcttgaggtatgcctctattgcttcgtctttcatgaagttcttcaccgtaccctctcttcctgcgagaggcaggctattcaagaacgaagtggtaacaagatcgccgcgactgatcatatcgatcagtatttggctgagggcattcgggctaaagcgatttttacgggaaagaccggatccatccgaaagagaaatgtcggtatgctgcaatcctgtttgggaagtccaatagtttcggatgacggacagaccacgctctgttgtattaccccgatgattcttcgatgcaaggggagccaactgtttgacaaaagcctctgcaaaatgattcagactacggaaattcatcacccgcaccaatgaatccaatggaagggattcgtagattaataattcttgagtgatcggtacggcttgatatgaggcacggcacttcccttggcacagagtgccggcagcagacaataagcctttggcccatgcagctccgtatagagcaggatcgggcaaatccgtcttgaggcggtaggaaacgatatttgtcggaaggactcccgtaagggttcgcttaagatccaacccttcgccatagcatccggcagtatcctttcctcggtggattacctcgattctgttttcccaccgaacctccggatgaggaggctctattctcaggatatgagcttcggagcctgctttgcctgtagcaaggatgacatctattctattatcattgatgttaaatccatagacgccggcaccgaaatagttgcctttgtcttcatcgagccaactgtcattgactccctcaatgtcaaaagctgatgcatcgacgatgatatctcctgttatttcttttatgccccattgcttgacggcatcgaccaaagcataggcaaatcgaccggagtccgtcggtaaatagttggatgcgagagaaggatctcctcctcctttgatgatgagattaccgtcaagaatcccttttcgaatttttccatccatgccgactccggtatagaatggtatctcggttcccctcagacgcaaaatggaagcagaggttacgagcttaaccagagatgccggacaaaactgttcgtctcttcgatttgatacgaaaaggctatcgtcccgacagcgacgtatctccacgccgatacgacttttcgtctgtctctcagctttcttgatgatatctattgcaccccgatcttgtgcagaaaggctctgcccgagaattgcaaagagaagaaatagaagatattgtcttaaaccccaatcggtcgttagagttctcctttgtgatttcatttctgatttcatttggaatgttttgagcatttgctacttcttagaattgatgactgtcgaacttgttgtttgattgcttctatcagtttgtccgcaagagcaaatttacgaaaccaatgctcagattttgaataataacccgaattaagaatatcagtggagaaaataatacgatgtgaaaaaggctgtgtggaggaaaaatccacacagcctttttttatgtctacctgaggagtattctcaaataaggggccttatttgagaattttc

SEQ ID NO: 564 - DNA (genomic), 396 bp, PORYPHYROMONAS GINGIVALIS; double-stranded, circular
  misc_feature 1...396
  hypothetical: NO
  anti-sense: UNKNOWN
cagactttgggcgttgagctgtatttggaagccggcatccgtggtgttgagatcggttctatccttgcagaccgtgaccccgtgacgaaggagaaccgctatccgcgtctcgagctcctgcgtctggctattccgcgtcgtacatatacgaacaaccacatggatgttatcgctgctgcggtaaagaatgtatacgaccgtcgcgaaagcattacacgtggctatgtgattacatatgagaatccaatcatgcgtcacttcactgttgagctggaaaaagccaagtaagcggtaagaaatctgtataaagaaaacggtaaaggaggttgcttccatgtcgagagaccagtggaagcaactttcttttttttgtggataaaaaggttttttgtttct

SEQ ID NO: 565 - DNA (genomic), 637 bp, PORYPHYROMONAS GINGIVALIS; double-stranded, circular
  misc_feature 1...637
  hypothetical: NO
  anti-sense: UNKNOWN
tctctttgacagagtatatgtcctcgtcgagagacggtttcgtcaataacagccggtaaatcggccctcctctctgcgagagggcagaaatcctgcaagaaatggcgaagcccttctctctccttcttgtactacacttttgttcttcgtatgaacaatgtcaatgatcgcgctccgactgccccctccccaatctccggatcgaagcccttcatgtggcggacagtgggtgcaaaagtaaaacctttttccgaatcggcaaaatcaatcgaatcttttttcagggctgacgctcaagaaaaagctcgtcgcctgatcctccccctaaaaaaagaatcccgacgcgctcggcggaacaattcctctatcaatcgggcagcaatcgcttttgcggtcacaaaagtacgccttttttctttacagacaaatctttcaaaatcttttctcaaccggttcgacaaaaaaaaacagcccccgaagaaaaggactccctcccaagaaagacaaaaaaagaagcatatatataatatagttcgcgcgcgtaagagagacccaaaaggagcgcaaaagaaacagaatgagaagagaaaaaaaattctgcgcaaaagacttttcagtcccaaaaggcggccggcta

SEQ ID NO: 566 - DNA (genomic), 1265 bp, PORYPHYROMONAS GINGIVALIS; double-stranded, circular
  misc_feature 1...1265
  hypothetical: NO
  anti-sense: UNKNOWN
gaggatccccgaaattttctcgttttcccggctccaaaatttggagcactaccgttttgccaagaatgtgctgacgctctgtcgcacggcaaatatcgctaaactgaatcccaaactgcccgagctggaaaaggctatcgaaatggaggatttggctctgaatccgcccgtcgcgaacgagctgacgcctcaggtcatagccctcgacgaggaacgcgacagagcctatcaggcgctgatgtcgcgcgtgcgttcgtatgctttcgacgaggacagccagctgcgcaacgcggcagccagaatcgaagacgtggccgctcgctacggcaacgtgatccgaatgaactatgacaaggagacggccgcgatagagaatttcctcaccgatctcaagggcgagaacattcgccccctcgtaacgaaactcggcgtgacggcactcgttgacagactggaaaagaacaataaggccttcgccgacttcttcctccgccgtctgagcaccgaccaacgaggcaaatatgacgtgaaggcactccgtgccgagaccgaccgcacattggtagccgtggtgcgccgcatggactccatcgacgacatggagccgagcccggagatccgtgcgctcatcgagctctacaaccgactcgtggccaatcgccgcgccctcttggctcgtcgcgccagctacggagaagcagccgtggagaagcgtcgtgccgagatcgccgagatgctccgccccctgctcgcccggatcgtggaggagaagaagacggccgtctttgccggtcgcaccctcggcacgggcaagaaccgccactatctcatcacattcgtagccgagaacggcgacgaggaggatcgctggtaccgcatcaacggggagcaactcgtctatgtgcccgaagacgaactccccaagccgaagaaaaagaagaaacccgcaagcagcacggacactccatccgagccgcccgtcctgccggatccatcgcaaggaggcagcagtagcggcggtggcgagcaaggctctaccggcggcggactctgatccccccgtgccgtcctgccggccgcagcagcacaggcaaccgagtataaaagacaaaggggctgtgaccaaattcatttttggcacagccccttgtatattcgaaaaattaggtgttagccctgattagcctttttctctgnttacaaactatgtctaaagaaaagtctatgctaggacttanccaacaaccgcattttcttacttgcgt

SEQ ID NO: 567 - DNA (genomic), 515 bp, PORYPHYROMONAS GINGIVALIS; double-stranded, circular
  misc_feature 1...515
  hypothetical: NO
  anti-sense: UNKNOWN
tctaataacgtctgtgtcgcattgataagttctttaatctcatcacaactccgttctttgaagtcgctttcattaaatagtttagattttgaaaatacatcatttacattgctttgctgtgctgaggatttaacagcgtcaagatacttctgcaattttatatcatcttcatcggatgagcaagtttttagcatatctgttactacatcgctaaattcacgcaagtaattctctgcagattcttcttgccttaccttcatatcactctcaaactgttcggagtcgtttctattggtattgagtagctcaaattgtttgatgtatttagcctttccattaaaacgactagcaatagcatctagggtgaaggtttttcctgtagaacgttttccatacataatattgagacccgttgataacttttgtccattcggaaatattggaaaaagttttattccttcttccgaagtcagtgatactttagtcttatccattagacagagtttcagtgtttg

SEQ ID NO: 568 - DNA (genomic), 536 bp, PORYPHYROMONAS GINGIVALIS; double-stranded, circular
  misc_feature 1...536
  hypothetical: NO
  anti-sense: UNKNOWN
ggcgaatgtctctttggttggacgacaagcagatagggatagccgatagtccgaattccaagggcgacacaacgctgcgtttctctgcatcgctctcgctggttccaggcacacatcatttgctgctcaagagcttgcttctcgaaggcgataccactgctacggatgtgcgcgtagtcctcaagccgaagaccgctcgcgattcgtcggctctctatcccaactatacgggcaaggagcggctgagcctcaagcacatgatgagcggcacatttctatcgggagggagtctctctccaacgggcaagtatgtacttacttcttatcgggtaagcagggataataagcctgctgtgacctataaccagctgcgcgatgccaaaggaaatatcctgctcaatctgaacgaaaaagaggcccttggttggatgccgcatgaagatatgctgatggtgattcgcaaggaaggaaatgcgaagcgtttggtggctttcgatccgatggggaaaggtgaaaaaaccttggtgtcccaattt

SEQ ID NO: 569 - DNA (genomic), 670 bp, PORYPHYROMONAS GINGIVALIS; double-stranded, circular
  misc_feature 1...670
  hypothetical: NO
  anti-sense: UNKNOWN
atttgtggccaacccgctttgtatcccaaacaatcctcgttcttcggaggtgatcaagtgttcttttgtcggtgaggcagagaaaatcgcagagctggaggtcgtgatgcggcgcgactatggagacaaattgaatatattccgctcttctgaaacgctgcttgagtgccttccgtccgaggtgcagaagataaaagccatatccgacctcttggacaagctggatttgtcacgagaggaacttgtttcggtcggagacagctactgcgatgtggagatgatccaactggccggcttgggtgtggccgtggcgaatgctcgggaagccgtcaaagcctgtgccgactatattacgacgagcaacgaggagaacggtgtcgcccacttggtggacaagtatatccgacacgaatatgaagccgttcctttctccgtagaagatgtcaatagtattgtgccgggtacgctcatggagagccttggtattcgctgcaccaagatcgcgcgtggctatgtcgaggcaacgatgccggtggatattcgcactcgtcagcctatgggtattttgcatggaggagccagcttggcttttgcagagaccctggccggattcngtttccgtggcantctgcaatnccggggagagatacanggtggggattgcanggtg

SEQ ID NO: 570 - DNA (genomic), 864 bp, PORYPHYROMONAS GINGIVALIS; double-stranded, circular
  misc_feature 1...864
  hypothetical: NO
  anti-sense: UNKNOWN
gctgattttccaagatgataccgcactgtgtttgtggaatgtccccagaccaattacaggcttacgacgaactgttatcgtatttccgtttttcagtgttatgatggagtagtccacttcacgttgcctgtcatatttcatgttttccatttaccggtgaatatcgatatgatttttatcgaaggccatgaactccgaaccatgtcggctgtgatgacagcccgtgcagagattgaaaaacgatcgtaggcgtacgacgccttcctgcacggtgcaggagaccagcgtaggcctacggtgctcattacaacatgctaattatcagtgcattatggccaattaaagtaaaacgagaacgaccttagaaattttccctgttttgcgtcttcaaaattcgtttccccccttgtttgggaagttcagactcaatagcagatcgacgacctcgactccccttgtcgtatttgaagcatcatttcttataatagaaagaagacacgtgaagatggtgatgatgtcatttttcagtacacatcgccttttctttatctttgtagagcatggtttcgaatttgggaccggcttttgaaatcagatacttctaagaaacgtttcaaagaactatgttattcgaatcgattacccctgtgcaatggtggctgatagcaggtatcctgctctttgtttttgagatttttaccccgggtttcttcttggcttgtttcggtatgggagcttttgctgccattataccggcggccttggggttgtctattgtgtggcagaccgttttttttatcgtggcttcgctgctctcgctcttcctgctcagaccttttatgcagaagagggcgcagaaggctc

SEQ ID NO: 571 - DNA (genomic), 570 bp, PORYPHYROMONAS GINGIVALIS; double-stranded, circular
  misc_feature 1...570
  hypothetical: NO
  anti-sense: UNKNOWN
tggaggactttaacttcgatgctcccaaaacaaaggctttcaaggctatttctgccgcattgaaggtgggcgaaaagaaagtactctacgtccttcccgaggtgaataagaatgtgtacttgtctgctcgcaacctgccgaatacgaatttgattcttgccaatctgatcaatacttacacagtgttggcttccaagaatctcgtgctgacagagcgttctgttgccgttgttaatgaactatttaaagcataaggaggatttggtatatgggaatcatcattaagccgattatttcggaaaagatgacggctgttacggaaaagatgtcggagcgttatggcttccgcgtttctcctaacgcgaataaaatagagattaagaaggctgtagaggctatgtataatgtgaaagtcgaagacgtgaacacgatgagatatgacggtaagcgtaaaaccgtataccaagagtggactgattcgcggtaaaaagcttctttcaaaaaggcgattgtgacgcttaagaaaggagaaacgatcgacttcttcagcatatctaagaaaaatgggat

SEQ ID NO: 572 - DNA (genomic), 606 bp, PORYPHYROMONAS GINGIVALIS; double-stranded, circular
  misc_feature 1...606
  hypothetical: NO
  anti-sense: UNKNOWN
tgcgtgatcagtttcatattgcggggaaagagtgtggagccggccggacgctgtatgcgcaaagggagttctatttcacgactttggtataaatcttcgatggcctgttccgcttttgcttgaccttctttgattggcagttgtttcaagtatcgttcaatatcccgtggatcaaggcctttttctttgatggttgccatgatttgggtatgttcctctctattctccaattgggtcaagtagttgtaggctgcttggtgtttggattcagcaagtcgtttctcaaaacaggcaataaaatctcgtatttcttgatcctccggcttgaatgaagtcggattttgggcataggcctctaatgcttgttttaggttgattcgtgtggttattcccacatcgtgtttcgaccaatcatttacggcatattcgaaagcggatcggatctgctcatcgacttcagaacgatgaaaactgtggatattcaagccgattttaatagctgcttttaatgcatactcgcctaatgttgtaatcatacttgtaatgtttgtggattagttgcaaatctatagaaaattaagtgtgtggcatgcaaaataatatgga

SEQ ID NO: 573 - DNA (genomic), 519 bp, PORYPHYROMONAS GINGIVALIS; double-stranded, circular
  misc_feature 1...519
  hypothetical: NO
  anti-sense: UNKNOWN
ggctcttcgcgagctggccgacttcctgatcgacatccattctcagcacaaaaatctcctgctcggcgacagtttgtttcagctcaatgtgctggatgcatatagcggaaaacccgacttatatgcccactacagcaaagcttaccgggtgtatgccgaaagaaaacaaaagttggaagaccttcgtaaggcagccgctgcgacagcgtcggagtatgactattggcagtttcgttttgagcagttggataaggccggtctcgaatcgggagaagaagctcgtttgcaagaagaacaggctatgctgacgcatgccttggacattaaaagagagctggggcattcctatagccttctctccgacgatgagagaggactactgtcgggtctgaacaaagtagaagatgctttggccaccatagagagctattatcccgactcggcttcttttcggcagcgagtacgcgatgttcgaatagagttggctgatattgcatcggatttgggcggcgttcggac

SEQ ID NO: 574 - DNA (genomic), 670 bp, PORYPHYROMONAS GINGIVALIS; double-stranded, circular
  misc_feature 1...670
  hypothetical: NO
  anti-sense: UNKNOWN
ccttgatctcaacatcatcgaggttgatccagaagaagtccgtacagccgaagtgacggaaggcaacatacttagtacccgcaggcaactgtaccgtcttttgataccaggtgccctgaacacgagtgccacgaatggcttccggtgccgtaacaactgtcttggccgtcagcacttcttccaacaaagcgttggcgaagttggaagcgtcgttacccgtagaagatgcatacacggcatagtgctctgatgcataattggcatcttgtgcacatacccagaaagtaagcgttcctccgttaggaagagaaagctccggtgtaaccagatagttatcagggttctgagggccttcaaagttgatataagaagccgaagagacacagattgcactgttgtgacctgcaaaagaggagcctccgggaggaggggtcgtcgtccaattgttgccgtcaccgtctgcatcgatcgtcttccatgaggcaggaataccattttcgaatgattcggaaagtgttgttgttcccggattcggattcggggtaccattaggtgcatcccacttgagcgttactttctggccgactgcactaccggtcaggttctgtacaggagcaaattcattggatccttctaccgtaacgtctttacataccttcggagatacgcc

SEQ ID NO: 575 - DNA (genomic), 532 bp, PORYPHYROMONAS GINGIVALIS; double-stranded, circular
  misc_feature 1...532
  hypothetical: NO
  anti-sense: UNKNOWN
tttgcttttccgtgtgaacgtttctttttcgaccggaaaaagttccaccttttcaatcaccgtcaaacctctccgtaccgattcttcgaaagaaatggattgggaagaatttttcctcaaaccgggattgggataagggccgatcggcttgctggcatctctatagtaagcgaacacttgaccatacgaatacataccttgacctctaagagcatcacgtgggtgaaagattcttctctgcctgccgagcttgctttcccatgcgtaaccgtgtggatggtcattggctgtacctctgcatgagaaatgagtaactccgcttatgtttccgttataggaccatacagctacttctccgttggttgcatcggcattttcacgtgtgtatacagtcgcgccggcatatcgttgcgggttgttggcaaagaaggcgtcccaactgctccatacattaggatcgccatagtaaggccctaccaactcggggtttgcatagctctcatagatgcttccccacgtccagncgtatgtt

SEQ ID NO: 576 - DNA (genomic), 726 bp, PORYPHYROMONAS GINGIVALIS; double-stranded, circular
  misc_feature 1...726
  hypothetical: NO
  anti-sense: UNKNOWN
ttgacggcaaacatgccgtagctctcgcgatagttcttcgtgatccagaaagcatactgcttggccactccgtatggcgatcgggggtaaaacggagtgctctcccgttggggcacttcctgcaccttgccgaacagctcggatgtagaggcttgatagatccgcgtttccttctccaatccgagtattcgcaccgcttccaagaggcgaagcgtacccacggcatcggcttctgccgtgtactccggaacgtcgaacgacaccttgacgtggctttgagcggccagattgtatatttccgaggggcgagtggtctgaatgatgcgtaccaaagaggagctgtccgtcatgtccccgtagtgcagattgatcagccgctcgcgcttcatgtcccgcacccattcgtcgagatagaggtgttcgattcgtcccgtattgaacgaagacgaacggcgcaggataccgtgcacttcgtaccccttttctatcagaaactcggcgaggaaagagccgtcctgccctgtaattcctgtgattaatgccactttctttttcataatcggaaagaccggattcctaatcttgaccggctcaagcaaataatatgattccctgcaaaagtactcattcctcccacgataatgcaggatgctttgtttttcctccgaaatgacagtagagggctgcctttgctgagacccctaangggatccccatcgagactcc

SEQ ID NO: 577 - DNA (genomic), 4712 bp, PORYPHYROMONAS GINGIVALIS; double-stranded, circular
  misc_feature 1...4712
  hypothetical: NO
  anti-sense: UNKNOWN
tcgagttgtcgaagcattcgatatgtttcggcggacgatccaagtgcaaatccttttggatcccgtggacgatatgtagggcgcgttgctcgggattgagcttctcggcacgtttgagtttgtcgagcttgtattgagctacgttcttctcggataattccagcagtttccgtttgtctccacgtcgggggatcgtagtcgtgatgctctctcccgtttgccaaccggtgtcgaacggcaaaacgatttcgtgagcgttgctttcgaatctttgtctcagctctgttatcgccgctgcaagaagttcttctttcgattcctctatctgctttctgtactccaaggtgtacacacgattgatccctccgtgctctatgtgcatgtagttgatataggccgtgtgctcgtcttcgtcgtaagagaaaacatctacgttgtctatattacgcggtacgaccgtgtgcttggcttcgtatcgctcaagaagctctattctctccttgcatatctgtgcctcttcgaagcgcagtccttcgctgtatacctgcatcctgtcgcgatacatgcgtacaagcctgtgcaagttgcctcggagcagatcgcgtatttccgatacattgctttcgtactcgttcgaagtttgattgccgatgcaggggcctttgcatttcttgatgtgatactgcaggcagacgcggtaccgtccttgtcggattttctcctctctcagatccagtttgcaggtacggatcggatagatctctttcacaaggcggagcatccctttggcaatgagtgcgcccggataggggccgaagtattcggatccgtcctttttgatgtcccgtgtggcgaatatacgtgggaaaggttcccgtttgatcactatgctggggtatgtcttcccatctttgaggaggacattataccgaggttgatactctttgatcagtgagttttcgagcagcagggcatccccttcgctgtccacaactatgtatttgatgctcctgatctgtctgaccagtatgcgggttttcctgtctgcgtgctccttgtaaaaatacgaactgaccctgcgccgaaggtttttggccttgcctacatagattaccttcccatcttcatcgaagtactggtagcaacccggtttttccggcagggtggggaggatgatgttcagttcgtcgggggtcatcattcggttcgatattttgtttcacgtgaaacgttatcttccgcagagtacgagaaggatgcttacgtcgtggggagagactcccggtattcgagatgcttgcgcgatggtttccggccggatgctcgtcagtttttggcgtgcttcggtggagagggactgcatctgcatataatctacatgctgcggaagtcggatactttcgagtctgttgatcttgtcggccaaggctctttctcttttgatatagccgtcgtatttgatcaggatctctgcagcttccacgatttcctctcgtctggatgccgggatctcttccacgattctttggagagagggcaccatcgaacagacttcattcattcctatttgaggacggagcagcaggtcgtacagtttgattccttgcttgagaggaaggtggccggccgactccagatgcgggttgatcagatccggtttgagggaaaacttgtgcgtaaagtcgatcagcttatcgcgaaatacttgcttttctcggagcaattcgctgcgtctgctgtctgccagcccgatcgcttccgccttcggtgtgagcctcatgtcggcatcgtcctgacgtagcaagatgcgatattcggctcgggatgtaaacaatgcggtagggctcgtccacgcctttgctcaccaagtcatcgatcagtacccctatgtaagcctcatcccgtccgagtgtgaactcgcctgcgccatggccaatgcaggtgagcattgatgccggctatcagtccctgtccggcggcctcctcatagccggtcgtgccattgatctgaccggcgaagaacagccctttcaccggcttggtttcaagcgtatgtcttaattgtgtgggatcgaagaagtcgtattcgatggcataccccggacgatagatgtgcacatggcgaagagccggaatggctttcagggcttcgagctgaatctccaagggcaaagacgaggagaagccattgaggtaaaactcgttactggtctctccttccggttcgagaaacagttggtgcatctccttgtcggcgaaggtgacgatcttggtctctatgctggggcagtatcgagggccgatgctttggatctgtccgttgtacaggggggagcgatccaaccctttgcttagtatctcatgacactcgggattggtgtagagtgcgtagcaactcctttggcgtagcacccttcggggcgtatccatataggagaaacggtggtgatcctcttctcccgactgctctgtggtcagactgaaatcgatgctccggccgtcgattcgtgccggagtccccgtcttcattctgtcggttctgaagcccagatcacgaagctgctccgtgatgccgtggaaagccggttcggctattcgtcctccttcgatcatacgctccccgaagtgcatgacacctccgaggaaagtgcctgtagtcagcaccacggtacgagcctgaaactctaccccgagagccgtcacgactcccgcgacggcaccctgacgaatagagaggcagcgtacactgtcctgccacatgtacagattaggctcgtgctccactatatcgcgccacgcttccatgaagcgcatgcggtcgctctgagcgcgcggactccacatggcagggcctttgctccgattgagcatacgaaactggatggccgtagcatccgtgacgatacccattcgtccccctaaggcgtctatctccctgactatctggcccttagctattcctccgacagccggattgcagctcatttgggctattttgttcatgtccggcgtgatgagcaatacctgcgaaccgagcttggccgcagccgcagccgcttcgcagccggcatggcccgcacccaccacgatgacatcataattgaattgcattggaatgtttccttagtaccggcggcagacaccggtgtcggccgtgattacttaacaaagttagcaactttcggttttggcatctatggagcttggcaggggatgagcggtatttgtctcggaatcaagctccccaaagttcatttcgcgtggagacgcatcatttcgtgcgctatcgtattaagagagaaggacgggtttacgcgccataattttctatttccacgctctgaaaaacgtggcgcgggaactttttcgttttggttcgggaagtgaaaaattctcgcgccgcagggaaaaaattctcgcgccgcttttcccgaaaacacgctccgcaatcagagcatttccggtctgtgaactttggagaggcggatttgtctgcaaaaaaaattatgccaattgcctaacctgctctccttttaccggagataataccttttagaggatagccccatattagtctgcttcataacgacctttacacggacgaatttttatcaatcgaattaaaagtgtgtccacttatttgtattaaatttggccttaactctaaaaacaatgaactaggccaatctttttacctcatttacccataaatggaggcaaagagagcttcttcccttcgggatgttcattgcgttttgatagaataatatatgtgttagagatttccaaggtctatgccacagatgtaattcgatcattttatagattgctcataaaaaaatattaagtgtatggaagctgaaacttacagtaggcatatctttatttttccttttcagtgggattacatcgaaaagagagggtatgcttcatataacgagaggacagatataaagaagtttgataaactgttttcggcagtcaagtcctctcaaaaggcaatacttcgagataggagcttcggaagaacgctacaatgaatcacctattttcatccttttgcccgaagagccctcttcggaacgaaagaaaacccttcggtctaccactatgaattgagcgacacccagggctcttacaacatctctgtgaaaattgatggagtctctacggacctactctctacaacttgagaagatagccgtatctgtattcgatacgggtgtgggaacggtagcctactttctccgcaacgataagcacacctctttcgaagacatactccgcatcaatgactcgggcagacgcatctaccctcaatatatggcgaaaggagacagattagccgccaaaaattcttttcttgccgaccgtatctatgggagtttaggagtgctggattttgacgacgacttccgtcaattcgaagaggatattagtcatacgaatatctttctcccccccgaccatatccgtcaggtgttcgggttaccaaccaagatggatcgaacggaagacgatgggtgccaaaagttcgtgtttcatcaagagagcgaacggaaagacatcatccgcatctcccccgttatggatgataggatgttctttataacctactaccatagcccctattatgccaaaaagttgagaagcaaaccgaaaaactttaggagaaagagagaatacaacatctacgaagagggacgctttgg

SEQ ID NO: 578 - DNA (genomic), 421 bp, PORYPHYROMONAS GINGIVALIS; double-stranded, circular
  misc_feature 1...421
  hypothetical: NO
  anti-sense: UNKNOWN
gggcattacctgctggcaggaaccatacacgtcgcagttaccgtaataagcaccgaaagcacctacggaagatataatcatattgtatcgggcctgactcgatggctttgtcaaccttaggcgcgcatcgttgaaccacatctgctccatgggaggaacgtagaaataggattcgccgaagaatttcacttttttgcttcctttttcttccagaaagaattctgctatacctgtcgtgtacgctgtaaaatagttgatcgtacctgtgttcggagaatcgacatccacggaataaccggctatcggacattgtgaattcaggatataaccatcctgaggacattaaccaaaccttgtctcccgtcgtagtagaggcataataactgctgtatgcccggataaccagatagtattctccggc

SEQ ID NO: 579 - DNA (genomic), 559 bp, PORYPHYROMONAS GINGIVALIS; double-stranded, circular
  misc_feature 1...559
  hypothetical: NO
  anti-sense: UNKNOWN
ggcttgccagtcgtcatcgcactgaatatgttcgatgagttcgagaaaaaaggcgacacctttgactatcctgccctgtccgccatgctcggtatccccatggttccgacggtgggacgaacgggacaaggcctgccggaacttttcgatacgcttatctccattcatgaaggacgaaacaaaatcatacgtcccattcgtatcaactatggcagcatcatagaaccggccgtagaagctctgactgagaaaataaacaatcagctctctctaccctattctcttccggcacgctatatagcagtcaagctgctggaaggcgataaggagatgaatcgcttcgtaggcgaacagcccaaaggtcttttcatcctttcggcccgggacttcgctctacgggagatcgacgaacatctgacagtggcgagagatgccgaaagcattatcacggatcagcgatatggattcatcgcaggagccctcaaagaaacataccggagcagctacaaacagctcaagaccctgaccgatagatcgatcatatcgtcacccatcgcgt

SEQ ID NO: 580 - DNA (genomic), 603 bp, PORYPHYROMONAS GINGIVALIS; double-stranded, circular
  misc_feature 1...603
  hypothetical: NO
  anti-sense: UNKNOWN
ggcaaaatcaggataatcgacgctttcggaagagtggcatccgaagtcttttgtcgtgatgccttgctctgcaagccatgcctttacgcgttctttcaattcatatccggcgtggtcgctacaaataccgattgtttccattgtctgagctgtagtttgtaaatacagattgcccgaaagctatattccgatttggaagtcgctttcgggcatcccgtggttggttatcagtggagtattttcaacacttgttcgtacacattctctgccgtaaagccgagtttctcgtccagcaccttatagggagcggagaatccgaaagagttcaatccccagacggcaccgctttcacccacaaggccttccaggttgacgggcaatccggctgtcaggccgaaacgcctgataccgatgggaagcacttcctcctgatactcggcactctgcgaacggaaaagtccttcggaaggtaccgacacgatacgaagttttacaccgcgtttgcgcagcagctctgcaccctcgaccaatgtggacacctcagatccgctggccaggagaactacttcgatattctgatccgtattgacgatataagctccc

SEQ ID NO: 581 - DNA (genomic), 567 bp, PORYPHYROMONAS GINGIVALIS; double-stranded, circular
  misc_feature 1...567
  hypothetical: NO
  anti-sense: UNKNOWN
gaaacttacttggccaactgtcgcatagctaaagacaatatcgctgtaacatctgtagcagatcagatcaaaatgctgaccaaagagcaaaaagaagagttgaaaaaattcctctaaacatctttttcccttatttcgttttcaggagctgatattatccgaatcggaatagggttactccaataggcaaggctgtccgggtataaaaacttcggcagcctttcttttttaggcaagaggagctaaggacaatagttggtttctggaccaaagatccggtatctaattattgctgtccggtgaacttggaggtcgtgcgtgtcagcgaatatctttcattggaatttgtcggcctgaaaatagagattcgcctcctataccaactcgtttcgacaaagagtgcagtgaaaaggaaatggatcggcatggttctgtatcgatagggtaaaatatccgctatctttggtctaatgatgatagccacaaaccaaggatacagagagttcggcgactacctcggcaggtatttccacactataaagtccagaagataccctcatgcagctt

SEQ ID NO: 582 - DNA (genomic), 997 bp, PORYPHYROMONAS GINGIVALIS; double-stranded, circular
  misc_feature 1...997
  hypothetical: NO
  anti-sense: UNKNOWN
aaggcggttacgaagaacttgaccggggtagaacttttttacccgacggcgcccgcctcttggatcgttcgggcttcgtgtatggcggcgccgtgcatctgtcgatggagctttttctgacggacagtctcttgctgctcgtcaaagctcagggacgcttgtgtttcggatcggatgtgaatctctttcgtcccgctctctcggcgggatttcgtataaacctctaaaccaatgaaacgatgaaaagaaaatggatcgatgcgctgtgggtgatgggagtattgctcatggccgggttttgtttatctgcttgtaatcgggagctggacgtgcagacggtttttccgtttgaagtaagcacgatgccggttcccaaacaaatcaaacagggcgaaaccgtggaagtgcgctgttccctcgtttcggaaggcgatttttccggaacgtgctatacaatgcgattttttcaaacggaggggaaaggtgttttgcggatcggacgcggggttgctctcaaacccaatgactgttatccggtgggtaagggagacttccgcctctactatacctcgcaaagcaaagagcggcagtcgctcgaaatcgtcttcgaggacaatcatggacaatcgcaaacgatcgttctggattttaatcacaaagaatcggacgaggataaagagcgagaagccggttaccgcacctgacggctccaataattccttttttgttcttaatcaagagaaggcgcccgtccgagaggataggcgctttccgttttccggaaaagcgtaaatcaggacaccggattgcaccttataatcttccatccggagctgcttctccttcattgattctccattgggaaacgttatttcgaacgttacttcatcatattcgtacaatgccgtggatggaattacatatacggcttccggtgcattacgggaccatccgaaaccgaaaagataaaacagatgcttgacaggtatcttgcttg

SEQ ID NO: 583 - DNA (genomic), 575 bp, PORYPHYROMONAS GINGIVALIS; double-stranded, circular
  misc_feature 1...575
  hypothetical: NO
  anti-sense: UNKNOWN
gccagaacgttccatccggggatgaaacacgtatggctgtgccatctgagcaaggacaacaaccaccccgacctgtgctggaaatccatcgaatatcgcctgttcagtgaggggattcgtgtcggaaaagatatggaactcaccgtactcaagcgtacatccccctcatctctatatactcttttagaggactgacctatagagactcccccttctcgcacttcatatactgcggcaaataagtacccttcccataactgtgattgttacaggagaagggtgacggataagattataggaattcctttttcagcgtctccatccgaaaggatgagaggccaggggcaaacgtgcaagggggtggtattcgcccttcagtcctacgggagaagcattgcgaatgtcatgaacgatctgaatgctgttgcgagcttcgtccaaaccgaaaccttcaccggccaaaatccgccgataactctcggtgtgcaacttccgtaaacccttcactgaactcgaatgattcgccgtcgattctatcgacgaaaggtcgcttctctcctgtacgcattctcggc

SEQ ID NO: 584 - DNA (genomic), 5919 bp, PORYPHYROMONAS GINGIVALIS; double-stranded, circular
  misc_feature 1...5919
  hypothetical: NO
  anti-sense: UNKNOWN
gaatctttctatctttaactcaataagaatcagattggaacaatgactatgatgcagtgggagcgattgctctccgacaaaagggtgggcatggagcactaccaccaaccgaaacaatcggctcagccatgggagagaacggacttcgaacgagattatgaccgcatggtcttttcttcaccttttcgccgactgcaaaacaaggcacaggtattcccccttgcaggcaatatattcgtacacaatcgtcttacgcacagtctcgaagtgagctgtgtgggacgctcgctcggcaataatatcacacgcggactgaaagcgcggtatggcgaattgccatgggagtcgggggccatcagtgccatcgtgtcggctgcctgtctggctcacgacatgggcaatcctcctttcggtcacagcggcgagcgtgccatttcggcttatttccgcgaaggaaagggtagggtatgggaggacgcagtccgcaaggaaggaggtcgctgggaagacttcctgcacttcgaaggcaatgcaaacgctttccgtctgctgacgcatcagttcgaaggccgtcggaaaggaggctttgcccttacgtacagtacggtggcttcgatcgtgaagtatccatacagcagcgagatggcaggcaaggccggcaaattcggattcttcgccacggaagaggatactttccttatgatcgccgaagagcttggcatgctatgccgaaacgaacatccggtgaaatacgttcgctatccgctggtctatctggtggaggcagccgacgacatctgctaccaaatcatggatatagaggatgcttataagctccgtatccttacttatgccgagacggaaaacctctttctggctttttgtcccgaggaggaactcgggcatatacggggagtactcgatcatatcacggatgccaatgagcagatcgcttacctccgttcgcgtgtgatcagtctgttggtcgaatcatgcacccgggtctttctggatcatgaggacgagatattgtccggtaccttctccggcactctcatcggagccatggaaccacggctgaaagaggcttacggggcatgtgcccgaatggcctattcgaagatctacgtggcacgcgacgtggtggatgtggagcttgccggacatcagatattcggtgcgctgatagataagatgatgcaggccctcaccaatccggatcatgcctatagccggacgctgctcagtcgggtaagtacgcagtacaacatacgggaggagagcctctacggtaagatacagtgcacgctggactatatatccggcatgaccgatatatacgcgctggatctgtaccgcaagatcacgggaatgaacttgcgctaaatctgtgtacctttggcccttgcggccgggtacggttcgtttttccaagaagaaaatcctatgaaaatagtactgatagggtatggcaagatgggacatgtgatcgaacggattgcatgcagccgagggcatgaagtggtgctgacgatcgatgccggagaggaagatcgtttcgattcgatagcgtttcgttcggccgatgtagccatcgaatttacccgtccggatgcggcctatgcgaattgctcgcgctgtatggataagtccgtgccggtggtgtgcgggactacggggtggacagagcgtctgcccgagctggaagaacgctgccgacgggagggaaagaccctcttctgggcttcgaacttcagcatcggggtcaatctttttttctcgctcagtcgtatgtttgcccgattgatgagccggcacgatcagtatcgtcctcacctgacggaaatccatcatgtacataagttggacgctccgagcggaacggctattacactggccgagggattgatagccgaatctccctcgctggacgcttggagactgacggagacaccggaggagaacgaactcccgatcacctccatccgagaaggcgaagtcccgggtacgcacagcatatcctatacatccgaggtggatcggctgacgatatgccacgaagcttttggtcgagagggattcgctcttggtgccgtgttggctgccgaatatgctgccacgcacaaaggctttctgacgatgaacgatttaatcagcttataacaacagaataacgatatgaccttccattggaaagatttgacgccatggcgtcgtataaaaggcgttgccattactattctttacctccttttttgtatatgggccggcccgttttggctgatttttctgcctttgatcgtagattattatttcttccatattatcaaatggggctggtataagaatatccgaaacaagacgcttcggatcatttgcagctgggtggcagacattatctactgtgtcgtagccgttacctttatcttcgctttcctgtttcagaacttcgccattccgacttcttcgctggagaagaccttgcttataggcgactacctcttcgtgagcaagctttcgtacggaccgcgttcgcctatgactccgctcggtgtgccgctgacgcacaatacgatgccattgacgggtggcaaatcgttctcggacaaacctctcttgccgtacaagcgactgaagggtttcggacacgtcaaggagggggatttggtggtctttaacttccctgcaggcgatacggtggccgtcaagcagcccaatccggattattatatgtggaagaaactcgtaggacgggaggagctttggagtaatccggatttctacggggagatcgtttaccgccccgtggacagacgcgaccactatgtgaaacgctgtgtgggtatgcccggacaagaattgagcatcaggaataatcagatctatatagatggcaaggagcagcgcaatccgcgcaatatgcagctgaactatttggtgaggatgagcagagagatgagtgtagacttgatagacgaactgggtatcagctacgatgatgtgcgtgctgcttcaagcgaggaattgaaagcttcggtcggttcgaatcttatcgattcggcgtcgaatcaacctcaaatcatttatcatttgccactgacgcagggtatgctggacaagctgcaagcagagccttctttcgtcaaggctgtagaggagcctacccctatcggccccctgtatccgctggagtatgaaacgggatggacgcgcgacaattacggtcctatcgtgatcccggccaagggcatgacggttcgtttgacgccattgaatctggccttgtacagtcgttgtattcgcaatttcgaaggaaataagctcgtgcaaaaagctgacggcacggttctcatcaacggccgtccggccgattcctacaccttcaagatggactattatttcatgatgggggataatcggcacaactctgcagatagccgctattggggtttcgtgccggaggatcatatcgtcggtaagcctgtattcatctggttgtccctgaataaggacaagagtctcttcggaggtaagatccgcttcggtagaatgatgcgaacggtcaatgcagattaaatcgcggtatagaaacagaatttttttcattggcttgccggcagtcgttctgttgtcggccgtcctcattcgtctcttccttgttactacctatcgtgttcgaagcgatgccatgctcccgacctaccggtccggaaagctgctatggatcaatcggattgcatcgccggacaggggagatattctggtcataaagtacagacaagatggcgaagcggactcgcgattctatctggcacggctgataggattgcccggtgacaccttgtttctatcaaagggtggggtagtcgcaaacaggcaaaaactgaagttgcccacctctttgcttcctcgtgagccatataaaattatcgttccgaggaatgacaggacttatcgcctgactcctctgtctttacttgcctaccgcagagcaatcgaagaagagtgcagttcgaacatcagctttcgccgaggaaaactctaccgcgacggtgccgaaacggctttcttccatttccgccgcaattactactggattctggcggacaatcctgcgagcggacccgattcccgccatctcggtattgtgccggaagagagtatagtgggagtggtcatgaacgcaaattgaataggagagtgacagagcgtatgaatctcctctctccttccgatccgatcgtcctctctacggcttacctgccaccgatccaatacttcacgaagctgttgcatcccgagggtgttcttttggagacggcagaaaactttgtgaagcaaagctatcgcaatcgttgccacatagccggacccgaaggtatgcaaccgctgaccataccggtcgaaaaatctccttctcccaaggcaccgattagagatattcgcatcagtgagcatggcaactggcgtcatttgcacctgaatgctcttatcagctcttacggttcggcaccgttttttgaccattatatgactgaaatagagccgttttacaggcataaatataccttcctttgggactttaatttggatctcctttccgtatgccttgaatggctggacatttcgccgttaattatgtttacttttgagtacgtggaggactgtcccaatgactttcgctactcgatccgtcccaagcaagctcccgaagatgaaagtttccgcccacgtgtttactaccgaacttttgcccataagtatggattcctgcccaacctaagtattgtcgatctcatttttcatgaaggaccatccgcaatacagaccttgaaggagtgtattcgctgacaaaaaataggtgagaaaaatctctatctttgttcgaattgataatagtatctgattatgacaactctcgaagccatacaggcaccgataaacggattcgtcaaagattttcatcattcgtttgagcatgcactcgattcccaatcggagtggatgacgaaagcgataaagatcttgaacggttccaccggtaaacacgtccgtccgctcctgaccggattggtcgcagccgtctgtgccggcaaaacgaattcgacgactcttgaggcggctgtcctgctggaaatgatccatacggcaacgctgatccacgatgacgtcatcgatatggcttctacgcgtcggggagtaccgaccctcaatgcttttttcgacaatcgtgtggccgttttgatgggggacttcgtgctctcttccgccttgatgcgtgccatcgctctgaatgatattcgcatcatcacgattatatcccggctgggacgtgagctgtcggagggtgagatcaggcagttcgagacagccgacaaagtgataatagacgaagacatttatatgggggtgatccgacagaaaacagccatgctctttagtgcttgtgcagaggtcggtgctattaccgttcaggctccagtagagattgtggaaagggtgaagagggtaggggagttgctcggctatgctttccagatcagagacgacatattcgattactatcggaatgacgtaggcaaacctacgggcaatgatatacgggaagggaagattacactgcctctgctgttcgctctcaagaacgagcagtctgcgctgcgagatcattgtctcaccattctggaccaaaaagctttctcggaagaagatttacagcttcttacctcctttgccatagagcatgggggtatagtttatgccgaaagaaaaatggctgaatttatagacaaagcaaaggctgagttggctgttttccctgactcagatgctctgcagtcgttgcttgctttggctgattttatcgtacaaagagcgaaataataagtcttgtactcattctttcttaaaagccgagct

SEQ ID NO: 585 - DNA (genomic), 588 bp, PORYPHYROMONAS GINGIVALIS; double-stranded, circular
  misc_feature 1...588
  hypothetical: NO
  anti-sense: UNKNOWN
ggcaagagcgaataagaggcaatcacctctatttattccgatgtattgatacaaaaactttctatttcttatgattttctgttacggagagtaccgatcagttctctcaaaggcttggttgtgatctcatcaagacccaattcgtcaagagccttttcggccaaaccgttgtgataatcgatcagatcttccacgatcggacgaatccccagacgattataaatacctgtcacagctcggatcttttcttcacactgcacatccggcatcaaaagggattctctgaggagattcaattcctctccctgagccatctcaagggctttgatcagaagcatcgtctttttattacaagctatatcatcgccgattttcttgccgaggataatgggatcgccatatacatcgaggaggtcgtcctccaattggaaagacaagccgatatgtatgccgtagcgatagagaatatctgctttctcaatatccgctcctccggctatagcccccatcttaaggctgtagccaagagaactgctgtcttcaaacgaatcatcttcaggtactcgtcctcggcaacaaagtcccgcc

SEQ ID NO: 586 - DNA (genomic), 578 bp, PORYPHYROMONAS GINGIVALIS; double-stranded, circular
  misc_feature 1...578
  hypothetical: NO
  anti-sense: UNKNOWN
gtcttcttgataaaaatcacaaaaaaaagatttggccgacatttgaaagagattgttttttggaaaaagtacaaactaatgaggttattccaatattcctggatgacaccaagttcccaggtatacctaatgacattgcttgcattcgttatgaagagaagcaggaagataagaagcgatctgaaagagtgcagcgagaaataattgaaagaataatttctaaggttcaatagttaattatagaaagggggatttattattttaatagattttatattgttgtatttgttgtcgtaaggagatgcaaatatttataataatagcttttttatagcatgatagttttcctcattaaagctgcgcagttgatcctcgcattcgccattctggttttcgtccatgaattgggacattacttttttgctcgtctcttccgagtcagggtggacaagttctaccttttcttcgattggggaggtgccatcttccgttcaagcccaaacggagcgaaacggaattcggatcggtggcttcctctcgtggctattgcagatcacgggatgatagacgaatccatg

SEQ ID NO: 587 - DNA (genomic), 813 bp, PORYPHYROMONAS GINGIVALIS; double-stranded, circular
  misc_feature 1...813
  hypothetical: NO
  anti-sense: UNKNOWN
tgcatcagggtaaagaaattgccgagcagatcaacatcctcggtgatgatggtgtacccgttagctaccacgtagtcttctggaaagcagaattgatcgactttgtgatccttcagcaagatgctttcgacgatgtcgattgcaacagctcgctcgagcgtcaggagctgatgctcagcagaataacggacatctgtcgtacggaattcgatttcgaagacttcctcgaggtttcggactatttcaagcgaatgatcaataccttcaagcaggtgaactattctcagttcaaaagtgctgaatttgacaaatacaataaagagttggacgctattctggccgaacgcatcaaataaattaagatagttatgtcaaaacaaagcttttcagaaaatatatacgaagattaccaatatcaccaaggcaacctgctctttgcgtgccaccggtgtgggtaatgaagagttggccactatcgacggccgattggctcaagtggtgcgtattcagggcgaagatgtaaccctgcaggtatttgccggtacggaggggattcccaccgatgccgaagtaatcttcatgggcaaggctccctcgctcaaagtgggagatcagttggccggccgtttcttcaacgcttatggcgaacctatcgacggaggcccccaaccggaaggaaaagaagtggagatcggcggtccgtccgttaatccggtccgtcgtaagcagccttcagagctgatcgctaccggtatcgccggtatcgacctgaacaatactttggtgacgggacagaagattcctttcttnggc

SEQ ID NO: 588 - DNA (genomic), 990 bp, PORYPHYROMONAS GINGIVALIS; double-stranded, circular
  misc_feature 1...990
  hypothetical: NO
  anti-sense: UNKNOWN
agcgtggcccgaatgctcccatcagaataccgatgatgatagggccgccggctaatcccagcttgataggcatactgacaccgggcagatagaaggggatcatgccgaaaacacatcccaagacaaggcctccgaacaaagtggtcaaatgaggattgtccaactgtttgacctcatcacccaaaatctcggccacacgctctacagccttgccttcgccaacgacggtcaggcggtcgcccaactgcaggcgaagatctctatccggcagcaattctactccggccctgtccacacgactgatattgaccccatacaggttgcggattttcagcatgccgaggcgtacgccgttgagcttagggcgagttattaccagcctgcgtgatacgagctgtttgtccacactgttccagtctatatcgggacggttccaatccttcatttctctcttgccgaagagtatttcgagctgtgaggtatcctcttcaccggagacagcgaggatgtgatcgccgaaatagaggatcatatcagaggtagggatctcgactttaccgttgtgccagacccgtgtaatgacgaaagggcgcttgagcaggagtgctacttcgcgaacgcttttgccatccaaagcaggattgcagatttcatactcggagaagaaagctttgggagcctcggaatcgtctcgttcctcgaccttgggcatcataactttcagcagggccaaagcaataataacacccacaacgcccaaaggataggtaacggcacaggccagacctttttcgcctatttcggccgtggcatcgggattgatctgatggagggtcgtttgggctgcacccaaagcaggggtattggtagtggcaccggccacgatacccatcagattgggcatggaaatgccaaggatataataaaggaggatgcacaggagaaatgtgagtaggactaatcccaaggagataagatctggcaatgccc

SEQ ID NO: 589 - DNA (genomic), 980 bp, PORYPHYROMONAS GINGIVALIS; double-stranded, circular
  misc_feature 1...980
  hypothetical: NO
  anti-sense: UNKNOWN
acgcgagttattacctctccgaagcaaggctgtacataatcgaattgagctgtaatacagcagttgccaatagctaagaagtatttgtccttattagtgagtgctttcagttgagaagtagtcagaagtggatcagcccatgcggtctcagatccatgcgctgtatagtttgcaaagctgactccggtattcaaatgactgtagcaacctgtataaggggctttgagatagttgtacacgtcggtataaccatgctcttggttgtagtagtactgcataccgtatttaatggttggctgacctacctgggaattccagctataatctgcacctgcaatcaagagaactttctccaaataactcttatctggcatagtagccttttcatacatcaataccttatcaatgatgttcgtcagttcttctggggaagaagcagacatacggaaagtatacatttcagggaaatagtcgccatcgactgcactgtaatacaagtcggtaactttttttgttttctttcctttttctccgctaataacgtcagtgtcaccaaccaaagccaagaagaccggagcagcactagctgccaatccatcattgtatttcttgtgaataaatgccttgatagaggcgtttgtcgttcctacttcagcttcgtctgtgtaatgcacatccagatagaagcccttttgagccttccaagtgagccaaggcttgagagcttctttgaattttgcacctgcaacaacaagcatacgaaccggcgtattatacaagtcgccatgatctgtataaacatctctattgaagagctgtttataagctgtttcgaaataagggctaaaagaagcatcatacaaacgttgtgtagctacttcatcagctccttgaaagcttacttcaatttcgatgttgtttctaaccttcaattggtttgcaaccacatcatactgaacaggattaatggtaagagctgc

SEQ ID NO: 590 - DNA (genomic), 414 bp, PORYPHYROMONAS GINGIVALIS; double-stranded, circular
  misc_feature 1...414
  hypothetical: NO
  anti-sense: UNKNOWN
caaaagcttagaaaggatttcccccggataaatatagtaggataccgagatggctatcttaagggtaacgatgatgaagtcctgattgaagatattgctgctaaaaagcccgatgtggtctttgtggccatggggtctcccaagcaagaactgctgatggagcgtatgcaaagggtacaccctaacgctatctatcaaggattgggcggtagtttcgatgtatatacggggcgccgtagagcgtgctccngagtggtggattcgccacnatctggagtttgcctatcgcctttatcaagcaagcccagtcgcatcaagcgttaagatacatttaagttaccgattcctgtttagagtatttaacccaatagnaatataaatttccattgaaaaaaaagtggatgttttggtctt

SEQ ID NO: 591 - DNA (genomic), 5538 bp, PORYPHYROMONAS GINGIVALIS; double-stranded, circular
  misc_feature 1...5538
  hypothetical: NO
  anti-sense: UNKNOWN
caggttttcctccatgagaagagtggcactccgatcatgttctcgactacgcgtgtcgtttacaatacgcagaatgagaagatcaatggttttatgcttcggcgtatgttcgagaaagctaaggatgggcgttatcgtacgatgggcgagattatccgatcggccaaacaggggatgctcagtactgttttccccgattcgatcaaccagttgagtttctttctgatgggtgatccgtccgtgcgtatgaatcttcctacccacaaagtgcaattgaccgcaatcaacgggcaggatcccgaagggcagtatggaactattatgctcaagtctttggaacgggtagctctgaagggtaaggtaaccgatgaaaaggggacattcgacgagacattcagtggcaaggttttcctgaccgtcttcgatggcagaaagaaaatgacagctttggaagaggagggaaacgatctctctcttgtatattatgactatcctaacgtgatgtatgccggtattgccgaggtgaaagacggactcttcgaaacttcgtttatcgtacccaaggatgtgaactattccgagcacgaaggccggatcaatctttatgcttataacgagagcacaaaggcggaagccatgggggtagacttctccatcagagtccaaccgggtattcctgatgaggtaacggaagataatacaccgcctgaaatcataagctgcttcctcaatgacagtacattccgatcgggagatgaggttaatcctactcctctgtttatggccgaagtattcgacttgaatggaatcaatatcacgggtagcggagtagggcatgatattacgctttgtatcgatggccgtgccgacctgacctacaacctcaatgcatatttcacaagttcggctactgatgcaggtgtgggcactattctcttcatgataccggctttggccgaaggagatcatactgcccgactgacggtttgggacattttcaataatgccgtccatcatgacttttcattcagagtggtagatggcattgctccggatgtggctgatgtgattctattcccgaatccggtacgcgagagtgctacgttccgaatcttccacaatcgccccggaagcgatttgaacgtggccgtggagatctatgacttcaccggtcgtcttgtgaacagtttgccagtcaagacctattcgtcttcctacggagaacctatagagatcaagtgggatctgacctccaaatacggagtgaagatcggaaacggattctacctctatcgttgtgtggtgaactctcccggaggacagacggcctccatggccaagaaaatgatcgtggtaggacaatagccgaagcagttctgccgtttacgatattgaatattcatagaccccgataagaatacaaaacaaaacgaacgaaatatgattatcaagaaaatgctgaaaaataaattggcccccttggccatactgttcctttttgctccaaaggctatgaaggctcaggagcaactgaatgtggtacacacctctgtgccatcgctgaatatcagtccggatgcacgtgcggccggtatgggggatataggtgtggcaacgacgcggatgcgtattcncagtattggaatccgagtaaatatgctttcatggatacgaaagccggtattagcttctcatatacaccctggctgtccaagctggtcaatgatattgccctgatgcagatgaccggtttctacaaattgggaacagacgagaatcaggctattagtgcttctctgcgttatttcacattaggaaagttggagactttcgacgaattgggcgaatccatgggagaggcccatcccaatgaatttgctgtcgatttgggctatagccgccagttgtcggagaacttctccatggctgttgcactgcgttacatccgctcagaccaaagcactcacaacaccggagagaatcaggccggaaatgcctttgcggcggatatagccggttatttgcagaagtatgtgctactgggtaatgcggagagcttgtggtcgttgggtttcaacgtaaagaatatcggaacgaagatctcctatgacggaggtgtcacgagttttttcatccctacttcgttgaatctcgggacggggctgttgtatccgatcgatgactataacagcatcaatttcaaccttgaacttagcaagctgcttgtacccactcctcctatcatggatcaaaacgatcaggccgggtatgaggctgcactcaagaaatatcaggaaacttcttcgatcagcggtatattctcttctttcggtgatgcgccgggaggactcaaggaagaattccgtgagattacatggggacttggggctgaatatagctatgacgataaattttttgttcgtgccggatattcatacctgcaccccaccaaaggcaatttgcagtacttcacggccggtgccggcttcaaaatgaacatattccgtatcgatgcttcctacctgttgtctacgatccagagtaatccgttggatcagactctgcggtttacgcttgctttcgatatggatggattgcgcaatttgttccactaaatcaagatgaagaagccttttcgaataggattcggtttcgatgtacaccgcttgtccgaaggttatcctttgtggatgggcggtgttcgtctggaacattccaagggcttggagggacattccgatgccgatgtgctcattcatgctatttgtgatgccctgctgggtgctgccgctttgcgtgatatcggctatcactttcctccttcggatcctcaatataaggggatcgatagtaagatcctgttggctcgcgttatggaattggtgcgttcacagggttatgaattgggtaatatcgatgctactattgcggcggaacagcccaaactgaatccacatataccggatatgcagcgtgtcttggctgaggtgatacaggtggaggtgtcggatatttcactgaaagccacaacgacggagaaacttggcttcacaggacgagaggaaggcatttccgcctatgccgtggccttgctcattgctgccgtctgagactaaccaagtcctaaaagattagttgcaaagaggttcctttctctcaaggatttggctcttattccttagacagctctttttccccctttttcgggggtattattttttcaggaggggaagtagcggcttgaccagttgccagatgacgattcccgctgtgacacttacattgagcgaatgcttcgtgccgaactggggtatctctaagcagaggtcacagaggtcgatggcttcctgtcgtactccttttacttcattgccaaagataagggcgtagcgtgtgccttttgagggggagaaattttccaaggataggcttccttccgcctgttctatcgcacagatactatatccttttgctttcaattcttctattgcatccactaccgaagagaaatactcccatttcacactgtcctcggctcctaaagctgtcttgtgtatgtcgggatgaggtggccgagctgtgattccgcacaagcatagcccttctaaccgaaaagcatcggccgttctaaagactgacccgacattgttcatactacgtatatcatccagtatgatcctgataggtagcttggggctttcgtgatattcttctgttttgagtcgctgtatttcgatagtcttttttttgcgcatgtctgttgtctggtcggattgagtgatcggtgcacattccattatcaaatgcaacgaatttctaaatataggatgaaaaccttgaatggcgttctgaagttcagtttttttcgagtgcagatcccatgtataagtgcaacataattgtaaatttagcaagaagcactcgaacggcgttctgaatccgagtttctttcttggctgtagttcagtttgttctgtataatggaaatctgtttggtcgttatatcgatgaaagaagaacctttagggatgtattgtctaatcagggcatttttgctcctcacagagcaaaaccctcttgtttacacgagaccgaaaagcagctcaagtaaaagctgtcttggatgcattagttagagtgattttctatctctgacaaaagtcgtcgaacgatatttagtgtcagataacgggaaacagttgtgtgtttgccgaaaatacgtatctttgcagcgcaattgaggggaatcctctccgttgctatgaggattgtctcatggtgtaatggtagcacaacaggttttggttctgtttgtcaaggttcgaatccttgtgagacaacaacagagaaagggttgtatcggatagtgaaacttccggattgcaaccctttctttttgtgtcttatctcccccccttaaattaccgtattactctctcaacttgttccctcgaatttctgcaacgaagcctattaaaagcgacctataagtcaaaagtgttggcaggattgcttgatagtctttctgtggagtgtgcagaccgacggcatgtggtcgattctgtcggatttgttatatttttgaggaaacgaaaaatcaggttatgctccgtaaaactctttccactccttatgatataattccccgatcggatttctctgccgatgtgctccgtctggaaggtgccgccatcgaggcagcccggtcggcatatgcaccttatagtcgcttttcggtgggagcggctgttttgctcgacaatggggagatcctttcaggcagcaatcaggagaatgcagcctatccgtccggactatgtgccgagcgtacggtgcttttctatgccggagccagatatccggaggcagccgtgagagagatggtgctcgtggctttttccgcttcgggacgtgtgccgctgattacgccgtgcggggcttgccgtcaggtgatgctggaggtttgtagtcgccatcgtccttttcccatcttgatggtcggggaagaggaggctgtcagagtgtcggatgtgcgtctgctgctgcccttttctttcgacggtagcgacttggaacgatagtcttcgtcctctattcttaatgtgagttcgatataaaggaatggcacaacacattggttattagtgtgttttattttccacacagtgtttttcaggcacttatattgctttcagatggctttttatctacatatgaagcccaatgacttagaagccgccccttcttcccgatcattatgcagccggagaatcacaaaagagtatgatttacagctactcgttatttttatggtatgttcgcttagatcgaactggcgttatatctcgtacccgaatggtttacacgccaaaatttttgcgcttgtggtcgctgaaaacatggcgtgaaaactttttgcttttggcgtgggaagtgaaaaaattacgcgccacaacgaaaaaattccggtgccacttttgggaaaaacacagaccgcaattttagcgttttgggttcgtgttttcgaatgagtgagtt

SEQ ID NO: 592 - DNA (genomic), 577 bp, PORYPHYROMONAS GINGIVALIS; double-stranded, circular
  misc_feature 1...577
  hypothetical: NO
  anti-sense: UNKNOWN
ggacaaagctaccggacgcatcatcaccgatctgatgtataagcattgggacgagtgggtggagaccataccacatcccttcatcgcgaacgcgacggatggaatgatcaccaccggcaaagacatcatggagggcgaaccctacgaggctccgatgaaaccgtggtcgggtatcgaagatttcagttggagccctgacggacagaacatagcatacgccaagccgcaagaaaacgggcatggcatattctctgtctaccaactcggacatatatatctataatctggcttccggccggacgcacaacatttccgaagggatgatgggctacgacacctatccgaagttcagccccgacggcaagagcattgcatggatcagcatggagcgcgatggatatgaaagcgatctgaagcgtcttttcgtgggcggatcttgccacaggaaaacgcacccatgtaaacccacattcgattacaatgtggatatgatccaatgggcaccggacagtaagggtatctatttccttgcctgtaaggagcagagaccaatctgggggagatcacgcttgaaaac

SEQ ID NO: 593 - DNA (genomic), 523 bp, PORYPHYROMONAS GINGIVALIS; double-stranded, circular
  misc_feature 1...523
  hypothetical: NO
  anti-sense: UNKNOWN
ctttgggctaaaaagatcaaaaggctggtcgatttttgtctcgcattgatttttttagctatttccctgccttttatgctgatcatagctttgatcattttcctgcaagacgggggggctgcaatcttctcacaagaacgcatcggtcttggaggaaagcctttcatgctatataagtttcgctcaatgaaggtgaatgcagaagccaacaatcagcctcagctattccagaaaaatgattcgaggctgacaaagttcggtcgtttcctgagagcttctcacttggatgagttaccccaattctggaatatcatcaaaggcgatatggctatcgtaggctacaggcctgaaagggaatattacatctgccaaataatggaaaagaatccggactacgccctactgtacgaaataaggccgggtctgttttcctatgctacgctgacaacggctatacggatacgatagcaaaaatgctggtgcgtctggagatggattgatatacttgcaaaaatcagttctg

SEQ ID NO: 594 - DNA (genomic), 949 bp, PORYPHYROMONAS GINGIVALIS; double-stranded, circular
  misc_feature 1...949
  hypothetical: NO
  anti-sense: UNKNOWN
attggatcgatacgagtatcggtggcaatatcggattctatatggcgaataatagtctgagcggacagaaagattctcgcacatacgattttggcggcaattatcaagttgccctaacgcttccctatggattccgtatcgacagcgatgttgaatacaatacgaactccggttacagcggaggattcaagtctggacgaatggctttggaatgcttcgctttcatacagcttcctccgtgacaaggccggtacactgcgtgtcaatggctatgacatcctcggtcagcggtcaagtatcagccgttctgcttcggccatcaatatagaagagagcatgtccaatacgatcggacgctacgtgatggtggactttatctaccgattcaacgccttcagtggtggtggatctcgcagcgatcatcagcgtggcaatatgaatcgtccgggcccacctttcggcggtggcagacgaccgtcctgatcagacgccacctatctgcaagagacaaagtgtgtaagtgtttttataacgaaccgatcgaggggctgtgtcaaaatttgattttgtcgcagccctctttctttgctccttgcagtcggttaggcaaccggcttcatcttggaggccctactttattagcttttcgaagacatagaagcgaatcaggctaagattgtatttattctgtacagacactgaaaaacagtcaattgacaatgaaatcttcccggaaaatgccatgcgacaatctcatctatcggtttaacaggctcacacggaacctcccactccccgaacctgccatccgacacagagcagatagcatcttccatcaatagaccatagtatcctctcatgtgagaccatagtatcctctcatacgagaccatagtatcctctcatgtaagaccatagtatcctctcatgtaagaccatagtatcctct

SEQ ID NO: 595 - DNA (genomic), 317 bp, PORYPHYROMONAS GINGIVALIS; double-stranded, circular
  misc_feature 1...317
  hypothetical: NO
  anti-sense: UNKNOWN
gggcacgaatgacacgggtattattcctgaccagcatactgcccgatggcagtacttccgataattgggaaaatacggcatcctttatctcacccttgtcataaacgagcaatttacaggcatcgcgctgtggcaaagcatgtttggcaattcgttcttcgggcaatggatagtcgtagtcggcaatggaaatatccgtggtcgtaatcatcgtggtatgatattttgcgcggcaaaattagcaaatactatggccgaacatgctcttttctgagtgtactgatcccattcgagatgttaaaaatcggatttctacc

SEQ ID NO: 596 - DNA (genomic), 609 bp, PORYPHYROMONAS GINGIVALIS; double-stranded, circular
  misc_feature 1...609
  hypothetical: NO
  anti-sense: UNKNOWN
gaggaagaaccaatccctctcggaaaacctacactcaacgaactgatggccaacccactggaaggaggaagcgaatacatcgaactatacaaccctacggacaaacctgtcgttccctctaaattcgccataggcatactccgcaatggaagctacaccaccacaactgcactgccgactgtagccgatacactctatccgggacaatacatcgtctttgccaagaagagtgagggagtcactgacttctacccccaagcgcaaaatgttgtcacgatgagcaacctgcctcagctggccaataagggatttacgatcggactgttcgaagaaggccttgatcaacctcttgaagaagtggtctattcacctaaaatgctcggagaaggaaaatgtaacgagacgagggggtatcactggagccgtatctccttcgagactccggattccgattccgaccaactgggcaggcggactccatcggcagggatatgctactccggctacctnaactnccaatcctcaatgcagatactcccagtagggctacccaataacgaaacagaagcaacggaaaagctacctgncacggcagtatagccgaagaaa

SEQ ID NO: 597 - DNA (genomic), 667 bp, PORYPHYROMONAS GINGIVALIS; double-stranded, circular
  misc_feature 1...667
  hypothetical: NO
  anti-sense: UNKNOWN
gcatggcttgttttgacctctctgcggctatggggggagaggctgaaacccgacaatggctgcgtagcgggctgatgcataccgatcatatacattatacggtgggtggatatacccgtcatggaggactggtggccgatgccttactcggctctattgtccgtggcaaaatggataggagcgaccagtncaaactctaaaatagccttacaaaccctgatgattacgcttgatttccggcatagcaggagtggacgaagctatgccggtgcgaatgacacttgtgcccccttaccaatcggcacaccactcggcatacgcatactcgcatcccgatgccaacaaactcgaaccgccgaaaaaaggaatcgggcaccttcctcttcgacaaaaacacgaaccataaatggacaaaacatggttcgtgaatttcgagaaactcgagcctaaaaattattcttttggctcgcaaaaatttcacttctcaaaccaaaagcaaaattttcccgcgccacgtttttcagaaccacggatcacaatcttttggcaccacaaataaaactctcggagccatcggtctttttatctcagcaaggatggtaaaattcgaccgattacacatgcctaaacctttttcgctaggcattgtgatagagtcatgttttcc

SEQ ID NO: 598 - DNA (genomic), 703 bp, PORYPHYROMONAS GINGIVALIS; double-stranded, circular
  misc_feature 1...703
  hypothetical: NO
  anti-sense: UNKNOWN
gcccttggactctccaggatcccccgaatgttctctgccacgccttgtttctcattcgacacagagaccgactcgaaagatgcactttgggccaatatcctatggcatagacgccttttgnngggggacgccacacggcccgaatagacaaaattcccatccggaagtagtacttaacccaacaaaaaaccaagaaataaagcaatgaatatcgataattcttccacaacgattcagggaaagaccatcgtcgtcagggcttgacgcattaaaaacagctttctaagtacttttatagtcgttaaagccccgttagttatgtatcattctctatttgaaagcctctgcatggttccggacccacggatagagcgtaaaaaaatttatcctcttgattttttactgctgatcgttttcctctctacactctcaggcaatacctcttggtatgagattgaagattatgccgaggaatacgaagaagaattgaaaagtctatacgaaatgcttaccggccatcagcttatgcataccatgccttctcatgatactctcaacaggagcatcagtctgttggatgtagaagcttttgagggggcttataagcgatggattgaaggctttatctcggccacttcgggtaaacatatttgcattgatggcaagacgatgcggggagtgaagaaactctctttcgatacac

SEQ ID NO: 599 - DNA (genomic), 659 bp, PORYPHYROMONAS GINGIVALIS; double-stranded, circular
  misc_feature 1...659
  hypothetical: NO
  anti-sense: UNKNOWN
cagccagtgttcccagttatataaaacaaccccagggatgcctttactacacccctgaggttcttttaaataacttgttccattgccggatttcgtctattgttcagtcatccgttcgtcgttgaatcggtgaaatctttttacatggctgtgaaagaggccaagaagccacagacaatccctgggaagttggctataacgattggccaatccttcttcttacgaataaaaccatatcctacccacagtacgcagttgatacctgcgaccattggctgaagccaatcacctttatgtccagagagattggaaccaatctgtggaatataagaaacatacatcgccatagctgttgccgtggcaatccaaccgagaactgacaaaaatttttcttgattcattttactaccatgtttagttcttgtgtttagcaaagatagtattcgcaaattaatcaaagtaggtatttaacaaagaaaaatatatgaggtcgatgattggtttaaacactgtatgttgcgccttctctgatgctatttctgtgccggcatagctctctgaggttgtacgagtgcagattcgattctcaaatatccatcgtgattattgttacacttgtgaaaattttcatggccgacatccgaataaagagaataccc

SEQ ID NO: 600 - DNA (genomic), 770 bp, PORYPHYROMONAS GINGIVALIS; double-stranded, circular
  misc_feature 1...770
  hypothetical: NO
  anti-sense: UNKNOWN
ggaaattaccctttaatcttttctatttaggcaaacactcaaaaaataatttttatgtatttgtccataacggagaatatgcttatggccaagatacctatcctactgtttcaaggccaataggtaagaatattcgcaaagtgcttcgtaaaattatgcggaaacagcccaaatatttattgttctgtccagaattggaagagatgaatacaatcctttatgtactaaatgacaagatatatgtttacagagttgcacaaatgaaagaatacgagttgagcgattattttaaacacttccctcgttgaaattgtagtatacctcaaaggaggggattgttcgaggttgcgctattttgggactttatatgtttttactctgcctcaaaaaaaaaagaatcaggtggttatggtgctgcagtcgtatacgaaagctagaagttgaataccacgcaggaagtaacgaaaaaatcaaaaacaacacaaaaaaacagaatcggggactagagccgggggcatagggaatggttattttcccactcatggggatttcctgcgccaaaagctatatctttgtaaatggaaccaatcagcgtggaaggatttgtaatgcttgcaacccacgagaaaaaatgctaaaacatttcttcttagaaagctctttcgacagctattctccaatgggagtgtgcaagcccttctgtgcgaaggaagttttacaaattaaaagcataaagatatgagctatctattcacatccgaatcggtgtc

SEQ ID NO: 601 - DNA (genomic), 385 bp, PORYPHYROMONAS GINGIVALIS; double-stranded, circular
  misc_feature 1...385
  hypothetical: NO
  anti-sense: UNKNOWN
gctgtgtctangtttggggnacccggatacagctttctctatttctgcctaaagatcaattatcgtcacgttggtttgttctatcagggatttataaaaacaaggactctaccccacggtatcgaaaactttagagactttccaatctttggagacgtttaagctcgccatcttggattaggaaaaatgttggcaatgatctgacattgaatgacaaagctgctttcccttcgctatcgttcactgtgatccaagggagtgtacgcgttgcattctgccagaaatacaagtccttgtcgacagaaatctcatatatctgaaatccattgttgcaatgtcgttgatacagtgctcgctgttcttttaccaaagaaggtgaccattc

SEQ ID NO: 602 - DNA (genomic), 772 bp, PORYPHYROMONAS GINGIVALIS; double-stranded, circular
  misc_feature 1...772
  hypothetical: NO
  anti-sense: UNKNOWN
ggattttgtctggtaacaacaaacacagcaatgaacattaacaactacacaatcaaatcgcaggaggctctacagcaggctgtggagctgacccgtcggcacggacagcaggccatcgaaccgcagcacctgctcaaggccgttatggatcagggcgaaagcctgaccgatttcctttttgccaagatggggctgaacaagggcagtatcgccacggctgtggacaaactgatagagaaactgccccatgtatcgggtggcgaaccctatctgtcgcatgagaccaatcaggtgctacaggcagcggaggacgcagcgcaccggatgaaggacaaatacgtctctttggagcacatcgtgctggctattctgactacgcgatgcgaggcgtccactctgctcaaggatgccggagccaccgaacagcttctgcagtcggccatcgaagagcttcggaaggggcgcaacgtgaccagtcagagtgcggaggaacagtacaatgcactggagaaatatgccgtcaatctctgtcagcgtgctcgcgatggcaagttggatcccgtgatcggtcgcgatgacgagatcaggcgagtgctgcaaattctctctcgacgcaccaagaacaatcctatccttatcggtgagccggggtgggcaagacggccatagccgagggcttggcttacaggatcgtgcgtggcgacgtgccggagaatctgcgcaacaagcagatattctctctcgacatgggtgccttgatcgccggagccaa

SEQ ID NO: 603 - DNA (genomic), 1091 bp, PORYPHYROMONAS GINGIVALIS; double-stranded, circular
  misc_feature 1...1091
  hypothetical: NO
  anti-sense: UNKNOWN
tcgcggcgtgtccagctcatgcttctttgatcacgccgttcatatagtcctctacatatgcacctacgacaagnccgtactgcgttttgccattcatggtctgggcataaacgtagtagttttcttctgtgtcttgtacgagccagcctttttcttggaacattctgaagttctcggcagctttttcatacacgtccgcatcgtgttcatcttttcctacagggaaatcgatctccggacggataatatgatagagcgacttttcgttgcccttcgcttctttacgagcttcttctgaattaaggacgtcgtaggggcgagatgctacttgctctacgagttctttcggaggacgtactcctttgaatggttttatgatagccatattttttgtcgaggcgaattatttgtttacacggaatttttcgttgccgtttttgatgaagtcaacgatttgacgagctgcagccagaccggcattgatgttggcttctgctgtctgagcacccatctttttgggagtggtgaagtagcgaccttcgaattttgccatttcagcatcgtttgtaggcttgatgtccgtagcatatttgaagtcggtacgctctgccataaacttgcagataccctcttcgtcgattacttcttgacgagccgtattgatcaggcaggcacccttaggcattttggagaggagttcggcattgattgattttacagtctcgggggtcttcgggatgtgaagcgaaactatatcgcaggtttcgaacagagcatcgcgagaagcaacggcctttactccttctttctcgatatccgctgcagaaacaaattggtcgtaagcataaatttccatgccgaagccttttgcgatacgtgccacgttgcggcctacattgccgtatgcgaggataccgagcttcttgcccataagttcagaaccggatgctccgttgaagagattgcgatacatgaatacgagcatacccattaccaattcgggcaacggcattcgagttttgtcccggcgtattcatcacgcacacattgtgggctgtagcagcagccaantctacgtggtcatatcccgg

SEQ ID NO: 604 - DNA (genomic), 3893 bp, PORYPHYROMONAS GINGIVALIS; double-stranded, circular
  misc_feature 1...3893
  hypothetical: NO
  anti-sense: UNKNOWN
gacatgactatctccgccaacgtgtcttgcaactctttggcaatatagatggtcttgcgatttttcaaggtgttgcgacagatgaaaagcgactcataatcacctttatcagcctttcgcctttctcttcttgggactcttgaaaaatcctttgacattggttcttcatttggacgttccgattcaacacactgctcttctaattgagagcgttttatttcgctctcatttcttttcatgggaataccctgtgaaacaagttcccggatggcaacaggatctaccttgccgttttggttttctgtcatacttacttaattttattgntatacaattcactgttcatttctttgccggtatatttacctgcaaagatgaatacatccactatctaagatatgcccgataatggggttgtaccagcagggctacatcctttcgttcataccctttttgtggagatgttcattgatgtccatcaatacaatcgttcgattgtatctgctttcacacatttccacgttcaagtgaaagaatcaaggacgtgttcttcgatataccccctcgcttatatcgctcatcgaatcgtgatatcatcgaagacacattcctccaccgacatattcgacggtgcaaatatatggctcggtgatgctgtaatcagcgtgatttactttagtgcgtacttgtggcttcgatttggatagttgtggcttcgtatgaggtaagggatttaggcacaacgcttagtaactttgcagtaagcgataagtcggtatttcatggctttgaaaacatacatttcgagagaataacatatcgttcttcggaacgaatttatttgcgtcagtgcaaatagcaaggtatgtcttgcgttacccgaaattatttcggtaactcaaaacccttgctcctgcagagggcagaacacctccgaagtcggtgttcttggatagaagttttcgttgtcttgattggctattttatcgtgaacgctctctaatggatttcaattatgtttagcacgttctatttccagaagagagaattacaaaccattaaaatccaaagtaatgacaaagagaaatgtggggcgacctcccaagaatgaacgagccgaccattgttgtatggttcgatttacggacacagaatttgctcgtttcctaacgctattcgagcaatcggggcttcaaaatagagccgctttcatcaaggcaagggtctttaatgagacctttcgagtgataaaagtggatcgttcgttgctcgattactaccaaaaactgacaactttgtacggacaatttcgcagtgtcggggtgaattataaccaaactgtagtcgctttgaaaagcaattttacggagaagaaagcctttgcgatgctcactaagttggagaaactgacactcgaattggctattattggaggggaaatcgtacaactcactcgtaaatttcaagagaaatggcaacatcggcaatagacatattatatcatattgctccttgcatggatgtaaaaatcagacttcccttttatttgaggaagcctgattaaccaatgcgattatcgctttttgaacttgccgcctttcagatcgctttccaccatacgcttattaagtttctcacggagttcatcaagaaaataggtgcggctatcatctttgcgacgtttcatgttcatatagacgttgtagctgttctttatcgccactccgaagatctccgagagagcgtctgccagttcctctacacctatttctccgttgttgatactgttgcaagtgtcgagagcataaaggagttcaactaatctgttgctttgcctgtccaacagagtttcttagcaggtctgactggcaatgcaggaagaagtccctgcattcgcattttcagtaattcaagctccgtgtcaatgacaaagagcagttctgatacattttttcccctctccgtccattgaatctcccctttgcaaaggttgcaggcaaaagcgtgtataacggagggtccgaaacaatgagactaaatctctttctgcatcacatagggcaataatcttcagaataaagttgtctgacgctttttgtatctgtccttttgtagagcataaagagattattgtcttaaagtcttcagtttgagtaagtcttagcataatcatatcttttatgttcaacattgtagattctctgttgtgagatgtgatttatgacgaatttccctatgaatttgaatggcaaagaacagtgtcatcaaagttgcaaagacgtcggctaccggttgtgcataaagcactccgttcaatccccaatatgatgggagcagcaatattacaggaataaagaagagtccctgtcgtccaatattgagcaaaaggctctgtcttgctcttccgattgccatatatagtgtggaatacacaaactggaagccgaaagtgaaaaacattagcgtattggctctaagggcaattcgtgcaatttcttgcattgtttcgtctttgccgaaacaactgataacaggagaagcaaaaacgagtatgaaagtgctccaaagtacacaaaatgaggttgtcagtatcaaggaacaacgtactgcctcttttaacctttggaaattttctgccccgtagttatagccagccatcggttggagtcccttgacaaatccgaaaaccacgttcgttcccaatgttacaattttcagaacgatgcctactgctgctacagcctctgccccatattttacggcagctctctgcaataaactaatcgaaagtgtttggaggagttgcaaacagagcattgaaatacctatctttatgatgtccaagtacattcttatcgttgggacgaacaaggcaaacgaaactttcacctctgctttcataaagaagcaggtgtaaatgattgttgtaatgattcttgaaagaatggttgcccacgcagcacctttcacaccccagccgaaagcatagataaatagaggatccaatgcgacatttataacagaacctattatcattgccgatgcagacgttttgaagccccctgagaaactataatattggacatcgacacattcaacgttcctatgacacaactaacgatgaacagtctgccatatgcttccgctaagctcatcatctcctcgtttgcccccatgaaaagcagaatttctggtagaaacgcattgcatacaagggcaatgagagcagctaaaatcacagaggtgatcactgagacggaagctacctgaccagccttgacaatttgcttcgcacccaataagcgagatatatacactccgcccccaacaccaaacatcagccctatcccaagaaacaccaacgataaagggaaaacaactgatacggcagcgacaggaagagttcccaaacgtgcaacccagaaagtatctaccacattgtatattgccataatcagcattgcgatgacaataggtatccccaactttgtcagggatttcatcatacttccttcttgcaaaatattcacagcgttgttcatccttataatctgtatcttcttaagtaaataaattctgctgcaaaggtacagggggatacaggtcgtcacaatagacaaacaacggtgataatagcactattcgtggtaattctttctgaaaagcgttggagaaactcctgcaaccttggtaaatagtcgtgtgaagtaggagtaatcgtcaaatcccaaaccttgtgctatctcttttacagaggttgttgtatagactaattgtcgcttagcttgcaagatgatttcatcctgaatattccgacttacactcgttccccaaacagcatttatcgcttcattcaggtaggcaactgttatattcaaacgttcggcaagaac

SEQ ID NO: 605 - DNA (genomic), 474 bp, PORYPHYROMONAS GINGIVALIS; double-stranded, circular
  misc_feature 1...474
  hypothetical: NO
  anti-sense: UNKNOWN
gtaatagtggggcgcattcggcaggatttggctaatcccagcggtttggtgttttggtgcgtatcggatcagatccggaaaggggctgcactcaacgctgttcagatagccgaatatctcatcgccaaaggacatttcgctcgctgacagcggtatcgctttgcgacatagcctgaaaaggataaactccgaaagccaactttaaccctcctgctttcggggtttgcttttgtcgtattataatgttctgttccaataagaatcgatctaaaaaagatattgctgtccggtaaaaaatgaagattctatcttgaatttcctaactgcccaagttttaccgatagcaatatgaaaaagagaccattgcacaataactcttctatcccttcatattgatcaagacagacacaagcattgattcgacgaaagtaaggagtgcttcatgcagtctttgcgaaccctcaagtatgggaa

SEQ ID NO: 606 - DNA (genomic), 865 bp, PORYPHYROMONAS GINGIVALIS; double-stranded, circular
  misc_feature 1...865
  hypothetical: NO
  anti-sense: UNKNOWN
ggttgttctcctgtatccaattcttcgtcaaaaactttgaaagcctcagaacatcctccgagattatagatgagaatgggataaaaacttacgaactcttcgtgcggaactgcagctcatagtagtgtagtaaaagcaagaagtcttgtatagggctaacacgttgccaataggagataaaagaagtggggccttgagagaaaaaagaatctgtcggtagagatatgtactgaaatagagtgtgacagttgtgaggatagccatcaaaagcccttattaatcgggatagtccaggtcttataggtcttataagatttattaattcattggagagaatcagatatagcactgtattgaagtccgcttgacttttttcaaaatctcctatctcataatatgcaactcctctaccattatacccaaggatgtatttatcgtctaattctattgcctgagaatagtctttaatcgcttttttataccatcctttcttagaatatgcatttcctctaccatgatacgcaggggcgtatttatcgtctaattctattgcctgagaatagtctttaatcgcttcttcatatgatcctttctcacaatatgcatttcctctaccataatacgcatgggcgaatttaccgtctaattctattgcctgagaatagtctttaatcgcttttttataccatcctttcttagaatatgcatttcctctaccatgatacgcaggggcgtatttatcgtctaattctattgccttagaatagtctttaatcgcttcttcatacgatcctttctcacaatatgcaactcctataccattatacccaaggtgtatttatcggctaattctattgcctggaga

SEQ ID NO: 607 - DNA (genomic), 581 bp, PORYPHYROMONAS GINGIVALIS; double-stranded, circular
  misc_feature 1...581
  hypothetical: NO
  anti-sense: UNKNOWN
gcgaattattacaacgtccaagttgttcgtacgtgcagccacaacagccatgaggtaataagtagtagcatcgggattctttatcccattcaggatctcttgtgctcggttgtagtcgcgattgaggatattggccacggcagcattgttgctctcggtcttaccgaaagccgctacagcctgggcataattgccctcttgcagatagagcaaaccaagagcttcgcccaattcgggcacattggcagccgagccgaaatactgcttagcctgctctacattaccctcgttaagagccaatagtccaaggttcatatcccgtttctgcattgggcttcacgcttgcagccttttggaaccaagtccgagcaccctccaaatcaccgctgcgataacgcatcataccgatattggtataagcacgatagtcatccggatagatctgagtagccaccttgtaaatatcttccttttgagcaggagattcgagcagagtacactatagagcagctcttcacgtcagccggccgggtctggctgcagacgttgatctgtatcgtctacctagattcgacattggc

SEQ ID NO: 608 - DNA (genomic), 621 bp, PORYPHYROMONAS GINGIVALIS; double-stranded, circular
  misc_feature 1...621
  hypothetical: NO
  anti-sense: UNKNOWN
cgacaacagccgactgcacatcacctatatgaacgtcgccgtaccgtttatgatgaagaagtgccgcagctccttttctctctatgccgctccggtgctgaagttcaagacggcttccagctctaaggtgtggttgccggacaacaagagtcaccagaaacacggtcgcgatctgaacctgaatcctatcgtcctcgaagctcgtgtcggtatcaattacagtgctttcaatctctatggttcttatacgcttacgcccctgttccgcagtggaaaaggacctgatacacgcatgttcgccatcggcttcggctttggtttctaaaaacgaaaaagcaatgaaacgtttctttttgaccaccgctatactgctgtcctccgtgcttgcctcttacgccgacagccttccttcggccgttcgcgatacggtgattcgtgccggggagaaaaccattatgatcaaggatggtgaggaccaatttcgaggtaattatacaggagtccatgccttccggagatacgatccgaaacgaaaagatattcagaggtgtctatcgcaatggtcgcagcatcgaacaacgctttcggaatactttgatcaatcggccgacagggataagg

SEQ ID NO: 609 - DNA (genomic), 1054 bp, PORYPHYROMONAS GINGIVALIS; double-stranded, circular
  misc_feature 1...1054
  hypothetical: NO
  anti-sense: UNKNOWN
gcattccactgtacgggattgtggctggctgtgatgatgataccgccatcggcaccacagcccgtgacggccatttcggtagtgggagtcgtggccaaatctatatcgaccacatcgcatcccattcccatgagagtgccgaaaacgacattcttgaccatgagtccggacgggcgagcatccctaccgactacgatacaggggcgtttggttttagttaactttttgatgaaatgagcataggcagctgtgaattgggctatgctgataggatttaatccctcatcggccataccgcctatcgtgcctcgtatgccggagattgatttgatcaacgtcatgatattgtgtgatgttagatgaatagattcctaagattagaggtcgggaggggtcagtcccgaaatacgtattccacttccttgtaatatccggtcaggcctcgcgaatagagcgattccgggccgattcggaaaggtacgatcaggcgcacgcgagctttattgccaagcatggtcatggggaaagcgactccttcgcagacgaacatatccaggttggaaccggtcgtacatttgatcagttcgaagtgaatatccccatcgttgtacttatatatatagcggaatacgctctcctgaaaaccgcctgaagtgagactgttgaagacatagatggagtccctctcacgattgaacatgaaaccttccatcctgacgttgatcttggtcttgttcagcacgggaggctctttccccttatccagtacctgcatataaagatcgttgtcgaagtggtacatgatatcgggatcgaattcgctttggccctcgtgcccatctttgatggtaaaacccatcctattgatgaaggattcgatggctttgcgttcgtccttcttcatttctttgagcgatttgatgtcgcttttcttacaactgcccaatgtcaaaacagccatacctatggccaaaaccggcagcaagatcattattatccttttcatcttgatcagaaatattctcctcctctattgcctttccgtccggttccn

SEQ ID NO: 610 - DNA (genomic), 5463 bp, PORYPHYROMONAS GINGIVALIS; double-stranded, circular
  misc_feature 1...5463
  hypothetical: NO
  anti-sense: UNKNOWN
tggacaaagaaaccaaacagagcctcttggctcgcactcgaagatgatcattcaggatattatagaggctatcgaggcggtctgcccgagggcttatcaagagagctatgacaatagtggcgtgcaggtgggcgacaccaagcgggaggcaacgggtgccctcctctgtgtggatgttaccgaagcggtattggaggaggccattcggctgggatgcaatctcgtcattgcccaccatccgattcttttcaaaccgctcaagcgattgaccggcagctcctacgtggagcgatgcgtggagctggccgtacggcacggtctggtgctatatgcggctcataccaatgcggacaacgctccgcagggactgaatgcgctgctggccgaacgcttcggcttgctgaatacgcgaccgctggagccgctgcaaggcaagctcttagaactggtcaccttcgtccccacggagtatgccgatgccgtgaggcaggctttgtggcaggccggtgcaggccgtttggggcattacgattgctgttcgttcagccatgccggcacagggactttcagagctgccgagggtgccaatccctttgtgggagcgataagcgaattgcaccatgaggcggaggagcggatcagcctcgtactgccggcatacaggcagggtactgtgctgcaggctttgcacgcggctcatccgtacgagctgccggctgtcagcctgatcccgctggccaacgatcatccctcggccggaggcggaatagtgggggatctgccttcgcccataagcgagcgggagatgctgctgcacatcaaggaggtattcggtctgaaggtcctgtcccattcggcttggagggaacggccgttgaggcggatggctatatgcggcggtagcggtgctttcatgtggcggcgtgcagcacaggagggtgcagacctcttcctgacaggggaggcgaagtacaacgacttcttcgatgcaggggagcatctgctgctggttacgatcggtcattacgagagcgaagaggtggctaatgagctatttatgcgcataatatcgcagaaattccctacctttgccacccacaaatcatcggttgcaaccaatccggtaaactatttgtagttagttaattgagcatcatggctaaagaaaagatcatcgttgagaacgaacagagcgtagaggaaaaattggcagcactgagcaagctgcaaaataccctctctgaaatagataagatcaagactctccgtggcgaattgccgctggaagtacaggatctggaagacgaaatcgccggaatgcagactcgtttggagaacttcacagccggatccaagcagctcaatcaggctgtaaccaccgaaaaggaaaagatcagtacagccaagacgctgctggagaaatataaaaaacagctcgacgaggtgcgcaacaatcgtgagttcgacaatctctccaaagagatcgaatttcaggagctggagatccaactgtctgaaaagaagatcaaggaatacaacgtcgaaatccaacagcgcaagaccgatatagctactctgaaagaggtgctggaagagcatagcgaggtgttggccgaaaaacgcggcgaactggataccatcattgccgagactaagcaagaggaagagaaactgcgcgaaaaggcgaagaagctcgaagccaagatcgaaccgcgcctgctgacggctttcaagcgcatcagaaaggctgcgcacaacggcttggccgtggtgcccgtagagcgtgatgcttgcggcggttgcttcaacaagattcctcctcagaagcagctggacgtcaagcttcggaaaaaaatcatcgtctgcgaatactgcggacgaatcatggtcgatcccgaaatgggagcataaagctccccaagagtaagaggccggtgtaggcggttttcgcttccggtcgatgcttcgggttcacaggtgcataagttttccgagataaggttcggctctcttcggagatgccggcaggactgatgagagaggacgagagttctctctttgttttatggcagcattcggcttattcggataaagagcctcttcatttccaagaaattttttccatcggcaggatggccgggccgatattttccccctgatatattcacaacaagatgaagatttccctgacaaaccgtgtccgaacgacgatcagagagcggaagctcttccgagaaggagaccgcctcgtactggtcgctctcagcggaggtgccgactcggtggctctgctctgcgtattgcgcgaattggggtatgagacggtggcggcacactgcaattttcacctccgaggggtagagagcgatgaggatgcagctttcgtggagcgcctatgccgagatctggatgttccgctccatcggatcgacttcgacacggttcgttatgctcgcgagcggtcgatttcgatcgagatggctgctcgagaactgcgttacgaatggttcggacagttgcggaaagaactggctatcgaatacgtggcggtggcgcaccatgccgacgataatgccgaaaccatggtgctgaatctctgtcgaggaacgggaatcagcggcctgtgcgggatgccctataagcggaacgatggtatcgtgcgccccctgctggatgccacacgggatgagatagaggcttatctgctcgaccaaaaaatcacctatcgtacggactcttccaatgaggatacgcgcttccggcgcaatctggtcagacaccggatcatgccgctattaaaggagttgaatccgtcgcttcaggaggcgttgctacgcactcgggagaatctggagggcgttgcagctttttactcgaaggcaacggaggattttcacaatacattgagagcaacctcttcgataagcattcgggaggtcaaagaaacacctgctccgtttacgctgctgtacgatctgctgcatccgtacgggttcaacagggatcagatacgggaggtggccacgtctttggacaatcctcccggagcttcttttttctcttcttcgcatcgtctcttacgtgagagggatcggcttacagtacttcccttatcgccaaagatggaggtgccggaactgttcggccttaaaatcggagattctttcctcgatctgccggatggaaagcaactgagttggcagcgcggtactcctgccgatttggacttggagggtctgcggcttccgaataccaagctattgttgcctttggcatttgtagaatctttacaggaggagcttggggttcgccgtccgcaacgaggggatcatattcatccttacgggatgaaaggctgcaagacggtgagccgtttctttatcgatcgtcacgtgccacgaagccggagggaagaggcttggctcctttgccaaggaacagaagtggtatggatcatgggctatgcggctgatcggcgattcgccatcgatgagctgtcggatacggaagaatatctgctcttctctttcgggctatagagcttgctcgatggctttttctcttgcccgggagcctttctccttcgcatccatcaggataaaataagcacggtaaaggcggagtagggtataggaatactgtccattgagacgttcatacaaggatttgagttcgaatatgcgagcgggattggtgaaataggggtgtaattcggaaacgatacctgcatctatataggcatcgggagccaatcgtcctttctctatcaaaagggcaaggtgcccttcgatggtactcggactgagtttccgctcggtagcgacctcttctatgctcatacctgccagtagcaattcgagcgttgtctcgtgggtagtctttttcttttccttggcttttttctctttactctttcgattgccggcggctgttggcagggcttcgtccttgggtgaaatgctgcgtacccattcggccatcagctcttccgtccgaagttcctgtctgctgaggctttggccgacagagagagcaccgaaaacggctcgtaagcgaagcaggcggtacacggcggtatgaagattgtcctgtagctcgagcagttctttcgcaaactgtttggcttttttcagcattccgacttcttggatcgtggaggaaagttcgcctgctatggcagaaagttgtggcaggaaatagtccacggctttgtcgattcgctctttgacggcaccgaatccaagcggagactgcccccaaaggccggcaagttgccggcgaaaacgtccggctacttccgtgatcgcatctatcttggccgattgttcggctgctctatcgctgtaatggcttttgctgctcagctcgctctcctcccgatagctgagactgtgtttgtgccatatattcaacaagctctgccagtcgaaagcctcgtcggattgctgcttccaatagataagactgttttcctgcaaagaagtccggagttctttttcgtcgggcttcgtctgtgcatattcgaccagttcttggggagtttccaacccacgcagatcgggaggggagagcagtatcattccttcagggcccgtcatacgtgacagggctacgtaggcctgaccgggaacgaagacaccttccagatctatggcggcgtgttcgaaagtcagtccttggctcttgtgcacggtgatagcccaagcggctcgaagcggaaaaaggcggaagctgccgattacttcctgttcgggggcattggtctcggggttcacggagtagcggacgttggtccactcgtgtggctctacctctataagctctccgccgtcagtccgaacgaccaccgaggaaggagaaagggagtggactacggctattttcccgttgtagtagcgtctaggttggcgagtatcattgcgaacgaacatcactctggcaccttctttcaacgtcatcgtcggctccaaaggatacagatgttccggaaaatcgcccttgatgatcgcttggtaggaatggggcagtgcaggtaaggcttccaaagcgcgtcgattgatctgatcggctttgtggttatgcgttgtcagcgtaatatagccttcgtgacaggtgctgtcgaaagtcggattcacatgatccttcaggtaggtcaagtcgtctgccggcagacgattgtggcgcaggttgttcagcaaggacgtaaagcgtacatctgtctgccggtatatggtttccagttcgaggaataccggcggatgctgacgaatcaccatggaatgaaaaaagaaaacgccttgatagattgctgacattagctcccattcatgcggtttgactaccggcggaagctgcataagatcaccgataaacaggacttgtactccaccgaaagatcggggattgctccgcacgcgacgaagaacaaaatcgatcagatccagcgtgtcggcacggagcatg

SEQ ID NO: 611 - DNA (genomic), 515 bp, PORYPHYROMONAS GINGIVALIS; double-stranded, circular
  misc_feature 1...515
  hypothetical: NO
  anti-sense: UNKNOWN
tatatccatgcaggatatagggctctttcccaaaacaggcaatactctcggcatcggtcaagaatatgccgatgtcgtgcagcatggcagcttcttcgacgaagagacgatccgcctgaagctcgggatggatttcgacgatacgaagagccaaggccgccacatcacggctatgctctactaaaatatggtattggttggttccctcagtgtagtacttattgatgatgctgatcggatccatcatttagggaaagagagttagacgggaagtgcccggagccgggatcgaaccggcacgaatttgcattcattggtgtttgagaccaacgcgtctaccaattccgccatccgggcaattgtcttttcgaatacgcgcaaaggtagaaaaataattcaatccgcaaatacttcttgataaaaggaggtctatgggtcaaaaagatggagtagtatcgaagagagaaagtctctcttcgatgctgccccgattgctttaatggcttttctattcg

SEQ ID NO: 612 - DNA (genomic), 675 bp, PORYPHYROMONAS GINGIVALIS; double-stranded, circular
  misc_feature 1...675
  hypothetical: NO
  anti-sense: UNKNOWN
gttcgttcgcaaaccacagtgacaggagtacaacccaagctatctctcgactttgaccaaatgagcaattcgcccaagcgatttaccatcgtgggcttgtggggacggtttattcttaaacctcaaacagagcgttattcgcatctccctgaattggaggatgtgtcaatgcaccttgcagagattgccaagatagaaacagttcctcatggactgatgcgatttagcgatggcgaactatgctatatcactcgtcgcatagaccgaacagggcaaggggaaaagctcccaatggaagatatgtgccagctctcagagcgtctgaccgaatataaatacaaaggctcacacgagcaggtagccaagctgatctccaagtatagctctgtgccaaaacttgatcttgtcaagtactgggagcaggtactcttttcgtggctgataggtaatgccgatatgcacctcaagaattactcgctctatgctccagagggaaatgaatatcaactcactccagcttacgacctgctgtctacggcacttgtattcctgaggatacagaagaacttgcattgaccctctgtggcaaaaagcgcaaactcactcgccaacacttcctcgaagcgatgacagcctcaggactagatgagaagtgtgtgacaatatttcgctcgc

SEQ ID NO: 613 - DNA (genomic), 982 bp, PORYPHYROMONAS GINGIVALIS; double-stranded, circular
  misc_feature 1...982
  hypothetical: NO
  anti-sense: UNKNOWN
ggattgatggagtggatggcaatgctgttccactgcccaatgtattggtcgaccatctgaaagaccggaatgttttggggcatggtgctctgttctttttagcaaatggaatagttgctacgggaaaatctcctcaagaaattgctgaaagtgtggctgtcggcgaagtagatcttacctcttaccccttctgttctgccaatgtcattgcagatacattggcaccgctcataacaggagggatgcaaaaaatagctgccaacagaaagagaagagaggactacatcgagactctcggagaagggcctagaccttatctctacgttattgttgctaccggcaatatatatgaagacgttgttcaagcacaagcagctgctcgccaaggagccgatattattgccgtaatacgtactacgggacagagtttgctcgactatgttccttacggagctacgacagaaggattcgggggtacttttgctacacaagaaaacttccgtatcatgcgaaaagccttggatgaggttggagaagaggttggtcgatatatcaggctctgcaactattgttcaggtctttgcatgccggaaatagccgtaatgggagcactcgaaggcttggatgtaatgctcaatgatgctctctatggaattcttttccgagacattaatatgcaacgtactttggtggatcaatacatgagtcgtgttatcaatggatttgccggcgttatcatcaataccggtgaggataactacctaaccactgctgatgccgtagaagaagcacataccgtacttgcctcggatttgatcaatgagcagctggctcttacagccggattgccttcagaacagatggggcttggacatgcatttgaaatggatcccatgctcgagaatggattccttttcgaattggctcaagcacaaatgaccagagaaattttcccaaagctccgcttaagtatatgcctccc

SEQ ID NO: 614 - DNA (genomic), 635 bp, PORYPHYROMONAS GINGIVALIS; double-stranded, circular
  misc_feature 1...635
  hypothetical: NO
  anti-sense: UNKNOWN
gaactcacgttaaagtagattatagaaagaaccagtaaaccaattgtagaactatcccggcccaactgtcaacttttttcagtacacgtcaaacttttcggttttggcgcgggagcgaaaaaattctcacgccactgcgaaaaaattctcgcgccgcttttcgggaaaacacgcgccacaatcggagcgtttctggttcgtatttccgaggctgtcagttgtagactttccgacaatggtgtagctctaactcctccatcctacaggctcggccaacagacaagcacgacatccccacacattgccctcgcatcagactgatgagatcgtgactgttgatgcaggaacgcataaaaaggaatttttttcggattcatttggcgcataacaaaaaaagcatacctttgcagcgtcaaaatcagaaggagctttccttttgatgggtattgactccgtagctcagttggtagagcaaatgactcttaatcattgggtcgtgagttcgagcctcaccggggtcacaaaccaatagcagagggctgtgttgaaatagtttttttgacacggccctttaacttttggatcggggttcgccttttgtgaaaggatatgggaaatatctgtcaaatgccgaa

SEQ ID NO: 615 - DNA (genomic), 949 bp, PORYPHYROMONAS GINGIVALIS; double-stranded, circular
  misc_feature 1...949
  hypothetical: NO
  anti-sense: UNKNOWN
cagtcctttcctggtcgggttcgtttcgcntgaacgaagaccgatactttgagtttgttttctttcatttttctgtcgtttttttctaaatttcctttgcttgcaaaggtacatacgaacaagtattcntgagcgatgcagaaaaatgaaagatgaggaataaaaacctatgacacagttgtttacattcaattcgtaacccctttttgctttttccctgatgggttacgatttggtaacggaactcctgccgtttgatgctcgttcttgcttaccctcaaaatagtaagaaaatgctaaatgatattatttcaaatagttacattccctgcatttccctctgtttcccttaattcttaatgactgattatgcccacaagatgagcttagatttacgcatgattgatttggagaggtactcggatcatatagacaacaaggcaagccactgtgccaagatgctcaatgactattaccagaagttcgatgcacagaagggaacgcagttcgttttctctgatttagggacttataagcccggaggagaattcaatgtctattcggagatcaaacgtaagttggtagaagactatcacatcccatcgcatgaagtacgctttatccaagagtgcaagaacgagaaagccaagaaagcaatggtggacgccatgaaccgtggcgacatccgcatcatcttcggttctacttcgatgttgggaaccggggtgtcaatgcccagcaacgtgcccgtggctatccaccaccttgatacacctttggcgtccttcggatttggagcaacgcaacgggcgttgccgtgccgtaagggcaatatgattgccaaggagtttgcggataacaagtncgatgtgattatctatgccgtagaacgctctctggatagtataagttcaatttgcttcacacaagcaagttgttcatcaatcag

SEQ ID NO: 616 - DNA (genomic), 2685 bp, PORYPHYROMONAS GINGIVALIS; double-stranded, circular
  misc_feature 1...2685
  hypothetical: NO
  anti-sense: UNKNOWN
agttgtaaatcccccttgaggagctgcttgcacgagctcctcaagggtggttataccttatcctagagatgaggacataattatccccggggttctgtataaattaaaggcgatgctttcaagaatgttttgagtatgggtcttggcaagtccccggtatcgacatcgtccgccatgaaaccaccggcgaatactgccaaaggtgcgttcgatggtgctccgtatctccacaaggcttgcatcgacaagcaccctttccctgaccgaaatgtgatggcgggaaagttgtttgttaaactgcgccaatagtttgtccatgagccccaactctgtcagtgccgaacgaaatcgactgatggtgctgtggtcgggagatacctcttccatagccccaagaatcgggaaaaggtgattgaatcattgatgcgctcctccaaagcacaatcactgaggttgtaccatgtcttcggaagcaacatcttgaataagagaatcacgtcataagccggggcgccgatggcattttgtcgcttcgtgtatttcttgttgatcagcgtcctgatcggacgccaatcgataagcctctcaacctgattgaggaagtcgttttgtgctttgcgataacgctttgaaaggagtgcgtctgcaaatgttacatgctcatcggtattcttggattggtatgccatgggaggaatattatgctgtttttaatgctcaaatatacaaaataacttcctattatacaatgaattaacaaataaaatgcaggccaattgccgtgcaaaggtctcaaaagctgaattaacttttttgactgtcagcttatttagttcacatcggcaagatcttgaaagtcatatccatttagccatatggttaggtagcctacagaataattttacttattaatcggtattgtggagatgcatggctggctatacctttgccaatgtaatagtaacacatttgtttagccaaagccatttggtcttaatgatgtaaccattataaaagtgataaatcgatcgcagtcggtaggacttcatagaaataccgaaaaagagcacttctccgggaggaaaggtgcttttttattttacgtcttgtatagtcttaaaaaacaaatccaccagcaagaccggccttactggtggataaaaatattgtactaaaagccgtagtgcttttatttgatcagagaaaatgtatcgataggcataatccctaccacaatgaggatttactcagccgaagcaggctgttcggtcatcagtttgttgaattcgtccggagaaaccgtcttggcatcgatatcgagcttttctttcaacgcggcagccagcttattttccgtaacacggtcgaagaaattgcgacgagcatcttccttctccatcatcgtattggcatagcgttcgagagcatcctgaggaacggcggacatgccatactgagcaaactgattcttggctacaatgatggcgaaattcctgacctcttgcggcgtaaccacgatgtcgttcttcttcaccagatcttccttgatcacatggaaagtcagatccttgatcatggcagggtactgcttttccagttcttcatcactccactccgtgtgcgacagtttcagccagcgcttcagcagggcatcggggaactgcaactctcctacctgagcttccaattcgcggcgcagatcgatgagaaatttgtagtcgctttcggccgtgaattgctcgcgaacaccttcggttaccttaacacgcaagtccgcttcgtttttgatatccgtctcctcgccgaaagcctgtttgaagaactcttcattcagttcagccttttcatgtcgggagatactgctgatttcgaaagaaaagtcacctgtatgctctccgatagccgacttgtccactttcaggagggaggaaagttcgtactcattattattgtatgccttcgagggattgaatacgacaacgctgttcttggcagcgccgacgaatttattcttctcctcttcgtccttcatataggccggaagcaacatggcttcttccacacagataccaccttctttgggttggccatcctccaattcgcaaagacgccccttcactacatcgttggcagtcacttcatcggcttccaccgaatgtccgtagctggatctcatagattcgatctgccggtcgatcatctcctctgtgggttggatcgtataataaggtacacgaatgctcttgtctaccactacgtccaccacggggctgagagccaggtcgaatacgaattcaaagtcgtcagtggtatcgaagtcgtactccttctgcaattcctcgttaggcataggctctcccagtacattgagtttgttctctgctatataacgatagagttcacgaccgactacgcggttgatctcctctgctttgacacccttaccgtacattttcttgatcatacccatcggtaccatccccttgcggaatccggggacattggcacgttggcgataggtacgcagagctttttccacttcgttggcataatcagccttctcgattgctaccgtagcaatggcattgacggcatccgtattcttgatcgatacgttcattttcttctttattatcttggagttattgtctttttggctttgaaaaaccgcgtaaaaatgtccgc

SEQ ID NO: 617 - DNA (genomic), 272 bp, PORYPHYROMONAS GINGIVALIS; double-stranded, circular
  misc_feature 1...272
  hypothetical: NO
  anti-sense: UNKNOWN
aatagctctttgggttgtagcatattcaagtatttatagagacctttgcacggcaattggtgtgtattttgcttgttaattgattgtatagtagggagttattttgtatatttgagtattaaaaacagcataatattcctcccatggcataccaatccaagaataccgatgagcatgtaacatttgcagacgcactcctttcaaagcgttatcgcaaagcacaaaacgacttcctcaatcaggttgacacgcttatcgattggcgtccgatc

SEQ ID NO: 618 - DNA (genomic), 475 bp, PORYPHYROMONAS GINGIVALIS; double-stranded, circular
  misc_feature 1...475
  hypothetical: NO
  anti-sense: UNKNOWN
ggtgagtaccgtttcgctggtggcatgtaccatggcttctaccatatcgccgtctttgaggaactggacgccgtcgatgcttgcacccggtatggtgatctgctcgaacgtttcggggtgcatgaagttgtatcccatctcgtcctgatagaggtactgatagggacgtcgttctattctgacctcttcgaccttgacgccgctgttccaggtcttatcgaggatacgtcctgtagccacgttcttgagtttggtgcggacgaaagccgggcctttgccgggcttgacgtgaaggaattcgacgatgaagtagtattgtccctcaatttcgagacacatgccgttgcgaaagtctgccgttgtagccatttgggtataatcgcttttttaatgatgacgaaaggggtagggggcggttctcgaaatactgccgatccttcgggatataggcaaagcctcctgttgcggaggcaaa

SEQ ID NO: 619 - DNA (genomic), 4534 bp, PORYPHYROMONAS GINGIVALIS; double-stranded, circular
  misc_feature 1...4534
  hypothetical: NO
  anti-sense: UNKNOWN
aggctcgctcccctactcgtcaagcagcaactggtgggttgcatcaacctgaaaacatttgcaatgctgacatccgcaatcgcataaagaaagggtatgtacaagagatcggcacgggcatgaccaaaatatagagcagatagccggactccgcccggagatcctcctgcaggatttattccacgtatcggacaaggacgaagagttgatcgcttcgggcatcaacaccgttttatacaacgaatggaaagagcgggatctactcggtcgtgccgaatggatgaagctaacggcgatgcttctcagctgcaatcgtcgtgctcatgaggttttcgaacagatagaatcggagtatgcggaggctcgcaaattggtggcagaaaagaccgataccattgccatcatgtatgggcaggactataatgggacttggtacctgcccggagagtacagctacagtacagccatgttcagagatgcacgagtatctttcgactatgcagccggcaaagtcagtagccagccgtgtagtttcgagtatattttcagtcgccatcgtcatgccgaaatttggatatgtacgatgatgggaaacatcaagacaatggatgaatttctcgctttgaacgaacgctaccgacatttcgatgccacccaaaccggtaaggtttacatcgatcgcaagcgcgtgaacgagaatgggggcaatgactactgggagagcgggctgtatcgtcccgatcttttgctcaaagacatcatcaagatcacccggccggagctgctacccgagtacgagacttcatactggatagaactgaagaggccatgaagcgatcatcattcatattcggcacacttcttttactgactgccatggctttcgtgaccgacctcatatggggcagtctggatatatcgccggccgacgtgctgcaagctctgaccaacggatcggaaatgcaaacaaccaatgactatgtcattcgcaatttccgtctgccgaaggctctgaccgctctctttgccggtgccggcatatccatcgcaggtctgcaaatgcagagtctcttccgcaatcctctggctgacacctctattttggggatcaatagcggagccggtcttggagtagccctgtacatcatgtcattcaccatcatacccggtctcagtctgcactccggcacggccgacacatggggcgtagctacggcagcctgcataggttccatgctggtacttctgctcatctcggctgtagcagcgtggctcagagatatggtctcggtgctgatcgttggagtgatggtcggctttttggccagttcgtttatatccattctccagttcttttccgacaatgaaatgctcaaagggtatctgatctggtctttcggcagcgtggccggcacgacatggcgacagctatccctgatgatccccattgtttcgggcggtctcttcctgtccatgctgatgcccaagtatatgaatgcgctcaacataggagagaactatgctcgtagcgtaggtatccacgtggagcgagagcgaattattctgatcggcatcacgagtatcattaccggaacgattacggcttttacaggccctattgcctttttggggatagccgtacctcacttctcgcgcatcctattcaaaagttcggactaccgcatactgctccccggcaccatgctgtgcggtgctctgctgatgctcgtgtgcgacatgatcacgcaggtaccgggcaaaggctttgtattgccgatcaacgccatcacctcgatgattggtgctcccgtagtaatcatgacgatcgctcgcaaccgcaaaaagcgtttaatcttcaactgaacaggcgatgatccataccgacaatgtgaccctgacgggactatctaccggataccgaagcaagaaaacggagcgcatcgtatcgaagctaatcgacctttccatgcttaatggcgaactggtaatgctgatgggtccgaacggctgcggcaaatccacgctcatgcacaccatcgcaggattactgccacctatttcggggaatatcaccatcgcaggacgcgacacacacggtctccgcatgagagagaaagccaagatgctcagtctggtactgaccgacaaaatagcagcgacgaatctgactgttcgggatattgtcgtcatcggacgctatccctacgtcaattatcggggtagcctgaccgcaaaggacaaggagattgtgaatgaatcgctcatagcatgccgactgatgggattcgaatcgcgccaatacggggaattaagcgatggagaaaaacagcgtgtaatgatagcccgcgctttagcccaacagactcccgtgatgcttcttgacgaacctacggcacacctcgacctgccaagccgtctggaggtgatcatcatgctgcgcgaattggcacgcaaaacgaacaagagtatcctcgtttctacccacgaaatggatctggccctgcaatgggcggacacggtatggctgatgaacagccaaggggagatttgtcgtggggcaccggaggatttggtactgaaccactgttttgaaaaagtattcggcaacgaaactctttccttcaatatagacagcggagccttctccgtcaaacataaaacggctacacctgtttctgtagaaggacagggtgctgcctacaaatggacactgagtgctttgcaccggaatggctatgtggaatctgcagatgcctccgaccgcaaaatcaccgtgggagagggctgctggattctgcaggagggcgattcctcgaaaagcttcgactccatcggctccttgctacaaacgctgcacgctcaccacgaatgaatgcttgtgaaacaaacaattatatgcaaaaccctacgatagatttcgacaaagaaacgcctctgttttttagtcctatgggcgatcctctttaccacttgaaagaaagtatgatcgttcgcttcgcaggacgcagaggagtcgtgagcacctgcaatctcaacggcggctaccgagaagacctccgctacgccttcaacaacagttgcgggagggaccccgacgtaatagccaaacgctctgtagggatgcgaggaaagaccatgatcgaacactacgccgccttagcggaagaattgggtctgcctcttgacaaaacaacgggcatgggtaccgctgctctgatcgaaaatacggcgacctcctctcgccaataccacggagtaacggtcatggcggttgccacggcaggtatagatgtaaatgggggacgcgcaggagaacctgccgcatacaacgaatttacccaaacagacctgattaagccgggtaccatcaacgtattcctgttcatcgacgcctcattggatgcaggaacactgacacgcgccctcgtcaccgccaccgaagcgaaatcggcagccctgcaggaactgatggcaaacagcatgtattcagaagatttggccaccggttcgggaactgattctctgatagccatctgtaataaggagtcggagatagtgcttcagaatagtggcaaacacgtgcttttgggcgaaatgataggccaaagcgtgaaagaggctattacggaagccttatcccgacagacaaagatgacccctacacgtcaggcttcgatcgaatggcagaccaaacgctacggaataacgagagaagcgatcgtctccgaatgcctgcgcctgtatccacatctgaaaaaagaggttgtagaagcaggaatcggcggtatcgatcgagacaaccgtctggtagccgcagtggctgccattgctcatttatgcgaccaaaatcgctggcaaatcatctcggacaagagcatgacctgcacagccgaaaacatattgcatacgatactttcggagagaggtatctccgaggaggcaaacagaaaggacattgtatgcggacaagatgcgccggcatatcgtcaagtgctgtccctctgcctccatactcttgcaagaatactccacaacagaattattcattcatcactttaacatatcaataattatgaaaaagtttttcttcgcgctactatcgattggtatttcagcgcaggcttttgccaagacggacaacgtcccgacagattcgctacgagtacacaatcttcagaccgtcacggtctattctacacgcacggccgtacctctgaaaaagataccggccaagatggaactcatctcatcgcgcaacatcaagcagtccggctttaacaacatgaccgacatcctcaagacgcaaagttcgctcgatgtcatacaatacccgggctttagttcgaacatcggtatccgcggtttcaagccctccggcaagtatgtaaccgtattggtaaacggcatccctgcgggaacggacaatatctctacgctcaacacgagcaacatcgaacaaatcgagatcctcaaaggcccgttctcttccatctacggcaccaatgccatgggcggtgtggtgaacattcatcac

SEQ ID NO: 620 - DNA (genomic), 586 bp, PORYPHYROMONAS GINGIVALIS; double-stranded, circular
  misc_feature 1...586
  hypothetical: NO
  anti-sense: UNKNOWN
cgtaacggctcatgacttatccacacgaccggccgtatcgacaagtttggccttgcctgtaagaacggaatgcgacgtattggagatttccactttgatcaaagggtaagtaacgccgtcgatctcgatcgtctcctttgcctccatcgtagagcgtgtgataaagatgtcttcgttggacatatccttaaacaccaccggacgataattttcgggatgaataccttttttcattgctgtctatttagttttgttcttgttttcgttcgctattgacgtactctggattggtaaccgttcgtttataatcggatagagatttccggacggcaaaggtagggatattattttacttggcaagcagttaggccgagtcaaaaatgagttcgatcattcatgtcggacattcatgctcttaagataagcaggaggggacgcatgctcgtgtatgtcgatgaatcgtgtgtcggatttacgaaccgcaatcgttgtaattgtggcgcgagaattttgaaaaagtggaacgtaaattatttcgttttggttcgagattttttttgttcccgaaccaaaataaaaaaattct

SEQ ID NO: 621 - DNA (genomic), 813 bp, PORYPHYROMONAS GINGIVALIS; double-stranded, circular
  misc_feature 1...813
  hypothetical: NO
  anti-sense: UNKNOWN
ggcagatgatgatacacggcaagcgcaaacaggctgcggtggagaccattgaggagaccggttggccggtgctattcagtgctctcaccacttttgttgctttgctttcttttctggctattcccgtcgtaccgatgcactttatcggtatcgccacttctgccagtgtcctcttctcctttatgatcgccattacggtgatgccgactaccttgagtttcggcaaagaccatcagccgaaagcatcagtgcgaaaagaaggaaagcatcggctggatcgatggctcgaagccttcggtgcctgggtgttggatcatgagaagtctgtctggggtgcttttatccttatgacagtggtgatgctctttggattcttgaaaatggagacggcattcgacattgaaagaacaatggggcgacggatagaatacgtcagcaatatccttgccgtgagcgaaagcgaattgggctctctttattcctatgatattatgatcgatttgggagaggagggaaaggccaagacccccgaagcacttcgtgctctcgacagcatcgctcgccatgcagaggcatattcccttaccaagcgtaccacttcgatattgaatatcctcaaggatctgaaccagaccttgcacgatggggatcaggcatactatagcattcccggcgatgcggaggaaagtggcaccagcagctcctcctatatgagaatgcngggggggagtgaagcccgaaagctggatagacttacgaataccagaccggttgctaccctgaaagttgggaaaatgaccctctttaccaatt

SEQ ID NO: 622 - DNA (genomic), 402 bp, PORYPHYROMONAS GINGIVALIS; double-stranded, circular
  misc_feature 1...402
  hypothetical: NO
  anti-sense: UNKNOWN
gccgccgatgcattaagagcagaagccaaggcttccgtactgattacaccatcagcgattttgagatccggaagatttattttcttcccttttactttggcttcgaaggttaagaagagttcactcttgtccatggccggcttataagggaaagagaatacgagctgctgattgccaccattgtcatagctgactacacgctcattgccaagtactttttctccctgaaaaaggaatgaaggtccccatgattcacctgtagcatagcgcagcacaggcttcactgtaagttcggctttcttattgaaccatttggcaggaaaagcgatactcacggtcacaggcactttgcttcccacgacttcagtggttgtggctcagcctttaccaaatcggcagtca

SEQ ID NO: 623 - DNA (genomic), 292 bp, PORYPHYROMONAS GINGIVALIS; double-stranded, circular
  misc_feature 1...292
  hypothetical: NO
  anti-sense: UNKNOWN
tgacaatccctcattttttcaaaggtctctatatcgttttactcgtcgccgttcgattgttttctttccggccggggaaagtttccccgacagccgacaaaaataatttttccggccggaaaatctctatccaaaggtttcggatatgtatccaaagcctttgaatacatatccgaaagcttcgtttatatatccgaaacctttgaataaagaattggattatggcttttcaacttttccgtactgcagaaaaaacttttttcggccgggacgattatttctttttataaat

SEQ ID NO: 624 - DNA (genomic), 976 bp, PORYPHYROMONAS GINGIVALIS; double-stranded, circular
  misc_feature 1...976
  hypothetical: NO
  anti-sense: UNKNOWN
acgatcggcagagagaccagcccgacgaagaggatgggcatcaggatcgtcatcacgaggaaggatttctttcggacgcgaatcatgtattcgcgttgtatgatagtgttaatgttgttcataacgtcagtgtgtatcggtggtttcttgttgtgcttggatcggattctcttcctctacgccgtggcctacggtcttgatgaatatgtcgtgcatgctcgggatctcttcgtagaaggacacgagccgtaccgactcgggcaggtcgcgcacgagatcgcggttgtgcgccgtggtttctttgcgcactctcagcttcgtcatggaacccggtagctccgtcttctccagtatccggatccggccgaggtagtctgccggcagctcgccttcgactaccatgcggataatgccgaggctgttctccctacgcacttcgcgcacggctccgtggagcactacgcgcgatttgttgatcagtgcgaagtcgtcgcatacttcttccaccgactgcatgttgtgcgtcgagaagatgacggtacgctccttgccggccagctccagtatttcacgcttcagcaggtcggcattgaccggatcgaatccgctgaagggttcgtcgaatatgagcaattccggttcgtgaatgacggtgcacacgaactgcaccttctgctgcatccctttggacagctcttccacttttttgttccaccaaggcatgatgtcgaacttctcgaaccagtcggtgagccgcttgcgcgcttcgtgcttgttcactcccttaagttgcgctagatagatggcctgctcgcccactttcatcttggggtacagcccccgctcttcgggcaggtagccgatgcggcgaatgtcttccgcctgcatgggatggccgtcgaagatcacttctccttcgtccgggagcagtaatgcggttgatgatacgtatcagactggttttgcccggcttccg

SEQ ID NO: 625 - DNA (genomic), 1571 bp, PORYPHYROMONAS GINGIVALIS; double-stranded, circular
  misc_feature 1...1571
  hypothetical: NO
  anti-sense: UNKNOWN
ctttggggaaagaaagaggtaggaaaacggctatcaggtgatcaggaaaaaagccaagcgtttgcttcttccttacctctttatggggacggtggcattcctgcctaaagtcctactgagtgcctacacataccacccgatgaggcctcctttttcggatatgtcagcagctttctttttccggcaacgaatgctattcgctttctgtggtttttgccctgcttgttcagtctattttgcctggttgttttttatcctcggaagtggatggagggaccgaagattttcggagcttacctcatcgcctgccttctgcatatagtcaccgaatacatccctgtggcattcgaggatgatcctttctgtattatagcagcctttaacaattttcactacttcgttctgggtatgatgttataccgctattccgatcgtatagtttccagacgagtatcggtagccctgcttatcgctttccatgtggcacttttctcccgtttctttatgcccgagcagtcatcgttcttgggggtattgaactggtcttattataccctgttcatcgttgtcctttatggcgtgtcggtaaaaatcggagacaaggtgatgcctgctccattgcttcacggtatagggttgtacagctatcccatattcattttttcatggttcgtgctggtcgcattgagaatagtcctttatgaccgctatgagctgagcaccatgatgatcaatggagctattgccattagtttcatagccggtttgttcataccgctttacctgtccaagtttttggacaggaaacttccggtttctctcaagccgctggtcggattgtaagcagacgcagaggagctgcgcaagaagggaaagttaaggttcgaacttacgaagagaaaaactatcgataacgaacggacttaacgacatgattccggccgaatcagggaagcctcgcaaatagccatagacacggctcacactcgcagagtccggcactgaagttgtcagcatatttattcccggattcacaggtcggctgaccgtaagaacggtattgtcggtgcaaaccaattggagaaacatctccatcgttgcatcaggacgaagttgtagacctctcagcctcgtgacaaattccaatcgggtgccttccttataagctgtacctggggtgatgatgaaagacctgttcaggaatggcatctccggccggtagaaacacgtactatctccggccagcatattgatcgaatccagttcgtagaacgaaccatcgagcatatccatccctttcttctcacgctccaacgtaatctgcttgtccagatcgattcgctgcttttccagttcatcccgaacgctttggcagatggcgatatactcttccaaatcatggcgaccataccacatcagcgtgctgtcgtaatccatgcgagtagtgccgtacttggcaaacagattgggtgtaaaccgcttcacgaacactatccgtcaattncggatcgtatatattagcaaagtgaccatcggccacataaagttcgaccatcagatccttcaacttc

SEQ ID NO: 626 - DNA (genomic), 7176 bp, PORYPHYROMONAS GINGIVALIS; double-stranded, circular
  misc_feature 1...7176
  hypothetical: NO
  anti-sense: UNKNOWN
atccccgccggcatgagcagccagtctataggttactacaccttcacgtacatcttcgcggttgggcagacccaaatgctccttttgcgtcacatagcagagcatggctgtgccgaaccatccgatctgtgccgcgccgatagccgatgtgatatggtcgtagccggacgccacgtcgctgaccaacgggccgagagtgtagaagggtgcgccatggcaggcttcgagttgaatctccatattctcgcggatcttgtgcatgggcacgtgtcccggtccttcgataatggtttgcacgttatacttccaagcgatctcggtaagttcgcccagcgtcttcagctcagctatctgcgcagcatcgttggcgtcgtggatgcagcccgggcgcaagccatcgccgagagatatggctacgtcgtagcgtgcgaggatttggcagatctcttcgaaatgctcgtagatgaaactttcgcgcttgtgggtggtgcaccagttggcgatgatggaaccaccgcgggagacgatccccgtgaggcggcgcaaggtcagaggcacgtggtgccaacgcagaccggcgtggatggtgaagtagtccacaccctgctcggcctgctcgatgagcgtatcgcggaatatctcccagttgagcttcgtcacatcgccctgcaccttctccagcgtctggtagaggggcacagtgccgatgggcacgggcgaattgcggatgatccactcgcgcgtctcatggatatgatcccccgtggagagatccatgaccgtatcggcaccccagcgtatggcccagacggccttttccacctcttcctcgatggtactgctgatgggcgaattgcctatgttcgcattgatcttgacgaggaaattgcgcccgatgatcatcggctcactttccggatgattgatattggccggaaggatagcccgtccggcggcaatctcgtcgcgtacaaattcgggcgtgatcttgcgcggaataacagctccgagcggctcaccctcctcagcgcgatagcgcgtcctgacctgatcgatcaactgattttcgcggatggccacgaactccatctccggcgtcacgatcccctgacgggcgtagtagagctgcgtggcacagccgtccttggcggcacggggacgcgtgcacacatgctcgtaacgcagcttttcgagcgaagcgtccgactgccttatccgtccgtattcggagctgagcccttcgagccgcaccgtatcgccccgatcctctatccactgctcgcgtatcttcggtacgcctcggtgcagattcacctcataggaggtatcggtataggggccactggtatcgtatacgactacatcttcgtttttctcacgttcgccgttctccaatatggtgtcggacattcggatgcgccgcatcggtacgcgcaagaaggggaaacgctctccttcgacatagattttctcactgccgggcagaggaccggtagtcactttgaattctttcatatcaatcgggtaatgggtttgggtttttactgttttgagactatcgccttgaagctgaaggtacgtcggtcagcccccataggtggcttggatgatcaggatctcatcgccttcggacagacggaagtccggccacgaggcacggggtacgacttctccgtttacggctatggccgtgcgctccacttggatccgctcggcttccaagagggcagccagtcccataccttcgaggcatgtgatcggttggttgttgatagtaacttgcatttgcgtgcttttgagggataatatctgttctttcacatgtggttgaccgtccacaatggggtgcttctcccgaagctgctggcacgcatagtgtgtattcgattctacatccctccgccggtattatccggatcaggtctatgggtattatctcagcctgccgtatcgcaattcttgccggcaagcacccccgtagcggtctgtcgagggcaaatgtaggtattctttcgtacaatccagaaaacacgcccgagaaaaagagaaaactgcaagaaaaaaatgttttcctccaaatccggctccgtcaatcatttaataatttgataccttcgctcccatttagaatcgataacacaaaaaaaatcactgaaatgaaaaaaactactttgacaggatcgatatgtgctttactcctgtttttgggtctctcggccaatgcccaatcgaagttaaagatcaagagcattgaggcagctaccactttcagttcggccacggccggaaatggttttggtggcaatatcttcggcatggacatgagcatacggatgagggtacaccacagcattctgcccgaagggttggatttttcggtaggaatacatgaaagaagagcacactgggaagaggccggaagtccgaagctcatgtatacgaatgtcccaagtatcattggtattgttgaaaaggtaatagtcttcgaagacgcagaagacttttttgacaaaaaagctctcggccgcttcctcatcagtttggggatatcctataccaagcatctgggagcgtattggggatggaccaatgacgcccatattcttttctcaccgatacccaagagcaaggtccactatgacacctacacaagagctggcagtgaccttgtacttcagtccgaagatgttgccacagtgagcaatggcttttcaccggggatcggactcaaaagttctatttggtggaaaatgcccatcaagagcaaatatgattttcgcctcggtttcagcctgggctatgagtatctgaacctgctatatccgtatcgtaatttcaagctggatggaaataagccgctttcagcactatctcctcgcatgaaccacatcggccatgtgggcttcaactttaccgtgggtctttggactaattgaaataatcagagccacttatggctttgattccaaattgaaccaagcggctctgtaagaggaagcggcacgtatgagagatatgtccgtcccaagcagagccgctttttcatgtgtcgagcttctcgcgtcttgcctttgcatctccctcctattgcatttgtgcgaggggaatatgcaccccgataaatttgtatcttagccgtggttgatattaatgaatccgaatttgtgaaaataaatgattgcagtatgaaaaacaatttttacagaagaagcttattggcaatgagcgtttttttcctcggcgcatgtgtcctttttggacagaaaaacagtgataagcaggatgatccgatcttgctttatcctcttgggactacatggtattaccacacaagtgaaaaaacgagtatggactcgccttcgtatttcgggtatatccgccatcgtgtcgagaagaatatccaaataggcgaataccaagctcaagagatacaagtggttcataaagattggacaggtcttgagaccccgatggagcctttttacctatatagaaaaggaggtaaggcctatgttgtagagtctgacggcttgcgactgctctatgatctcacagcagaggttggcgacgttataccccttcccgtcaaccaaggtacagccgtcgagggcttttctcatgggacgacaacggtcattgaaaaatccacaatcaacgtcggtgggcgtgatttggttcgacaagtttatcgcctgaattattattttgcggaaggcccgtggccggagcaaggtaagcttgtcgaagtaatcgaagatttgggcattttagagctcaatgcccaatatgaaaaaccccttccatatggaattattgtggactatatcaatcccaaaccattgctccgatgctttttcagtgatgacttccgatacaaagctcctttctgggacggacgtccttgctatgcctatggcattccaaatagtatgaccgctttgtccggtgaatcaacgcctttcagtgtcaatccggaatacatacgctttgacaaagaacattcaggccttacgtaccaaattctgaatgcaaatggtcttcagatgctgaggggtaacctgaaaggaggagagaccgagatcaatatctctaccttacagcgaggcctatacatcatacagtggcaagagtctcatacaggcctgaggcacagtgccgtcttctacaatacattatgaccgaaacggatttccgaatatatattgacgagaccctgtacttctgtgcagggtcttttttcatgccgataggggacggccgattggctttttgcatgaatccttttcatccaccgtccgattggccgtaagaaacctgtttttcatctatctcgatcactgaaccacccattcggccgtggcggcagcacacgcagagatttaaggaatgattgtaggctgtttcctgctcgttgcagcgatgcaggagaccggaaacacccgtttctgctcccatcaacacactctctatctgacatttacggacatttaacgcaagaagaaacgaatgcgtggaaatcgcgtctctctccccactattgctactctatgcaactcctcgaccgaagttgtagcgttactcggcacaatgcttttcagtacacgtcacgctccaaaattttcccgtttgacactcctaaaacatggcgtgggaactttttggttttggcgcggaaagcaaaaattctcacgccacaacgaaaaaaatctcgttccattttttcagaaaattcgaactaaaatcggtgcatttttggttcggatcgatgagtcagacgtgtactgtggtcagaaaaatatcatccataaaagattcgggaattagcagagagacaggctatggctaataggatcatcgaagtgaatcatcgcctcaaaaaaaacaaaaagcacacgaaaaagagccgcaaaacgcagaaaaagctcgtgcacaccaaaagacaagatatagaaaaccagacgagatctgggcaaaacaaaacgaaaacaggggatagacacgtcacacacataggacaccagagggggaaaagagacactgcccctttccggctatggcttttaatccgaaaaaaccgggcgtcaaattggcccaaaaggcaaaaaacacctcggagaggcatatcaatcctcaatcttaacctgatttgcttctacgtcatcgaaaagctaaaaagtaacgccagttcgatctaagcgaacataccataaaaataacaagtagctgtaaatcatactcttttgtgattctccggctgcataatgatcgggaagaaggggcggcttctaagtcattgggcttcagatgtagataaaaagccatctgaaagcaatataagtgcctgaaaaacactgtgtggaaaataaaacacactaataaccaatgtgttgtgccattcctttatatcgagctcacgtaaaaagtagggtttcaagatgaagccggttgcctaaccgactgcaaggagcaaaaaaagagggctgtgacaaaactgaattttgtcacagccctctgtcatttggaaaattcttcagtaattattctgcgctctcagcagcaggagcttcttcggcagcagcttccacgggagtttcttccgtttcggcagcttcttcggcagcggcagcagcctctgcttcagccttagctttggcctctgcggcttttttctctgccacagcttctgcacgagccttgtttacggccttctctgcttcgagcttaaccttatcgtccgctacagcggcttctttcacctttgccttcatgttgttaagagcatcttttttgcccttcaaccaagcctcgaacttgttttctgctgcagcttgatcgaaagcacccttcttaacaccaccaaggaggtgcttcatcatgagcacaccctcacgggacaaaatattacgtgccgtgtcggtaggctgtgcgcctacaccgatccaatacaaagcgcgctcgaaattcaaatctattgtagcaggattcgtgttcggattgtatgaaccgatcctttcaataaacttgccatctcgtggcgccctgctgtctgcgacaacgatcttataaaaggcataacctttgcgaccatgtcgttgcaatctgatttttgttgccattcttttgaatttattatttgcgttcgctattgtattagcggctgcaaagatagattattaaaatggaacaaacaaagtggctttctcttggcacataccacaaaaaacgatcgggtacagataagcgctcagcctgtctgtacccgatcggatggtggagctggagggaattgaaccctcgtccaaacatggaatcaatatgctttctacatgtttagtttcagttggaattttcgtgagcgagcggaggctgaaacgacccaatgcacgatccttatcttccgttcgatctgaccacaggcaggaagcatcctgtagcggttcccgatttgtcagcaccgcaccatcgagctacttcgggaaaaagctgctcgggcgatgtctcgtcgctgccactttggcggcgatgaagcgtctaatctactattcttcgattacgcagcgagagcgtagttattttcgccaattaaacttttgatgtctgagattatagtgcaagccacccacgcactacatgcttacataccgcttcatcacgctgtcaaagccggtcagccccattgtgggtatcgatagtgggagcaaatgtagcattatttaccgaagcgatgcatcttttttttcgaaagtttttcattgatcatttactgacgtgtacttgccgtttgattcccttcggaggaaggaagcaatccagaggggaaaagagatggttttcgcctttactccttacctttgtccggatcaggatgtttctgatcagatataatgaggaacaggacaatgcacaactttgccatcatcggtgtggccggctatattgctccgcgccaccttcgcgccatcaaggatacaggcaaccgcttggtatcggctatggataagttcgacagtgtgggtatcatggacagttacttcccgaaagctgccttctttacggagcaagaactgttcgaccgtcacaactccaagctacgaggaaccgatcaggctatcgaccacgtgtccgtttgtacaccgaactatctgcacgatgctcattgtcgctatggcctgcgac

SEQ ID NO: 627 - DNA (genomic), 603 bp, PORYPHYROMONAS GINGIVALIS; double-stranded, circular
  misc_feature 1...603
  hypothetical: NO
  anti-sense: UNKNOWN
gggctgggcagttgctggtgtcaggtcttcggatcgcttacaccgaatgggcaggaggctattcagtatgtgcgcaatacgctgaatattccctatcagttggaagtcctgtgcatcatcgctatcggacacaaagccgagcacagggatccgcgccctgcatcggaattgaagtgggagaacgtttttataggcgaatatcccgattgggagagtgtgtcgcatgattgatcctgtaggactgcccgatactttcgtgcgcatagtgcttgtcggcagtggaaatctggctacccaaacggctctggccttgtccgaagccgccagtccgcccgttcaggtatggagcaggaatgccgagcatgccgaacggttggcttccatgctgccgggagcaaccgctaccgatcggacagaggagctactctgcgatgcagagctttatctccttgcagtgagcgaccatgctctcgaatccgtagctgctacccttccgcccacatcgggaatatgggcacatacggctggcagtatgccgatggatacccttcgcccttatcatgcgcagatcggggtcttctatcctcttcagacattcagccg

SEQ ID NO: 628 - DNA (genomic), 317 bp, PORYPHYROMONAS GINGIVALIS; double-stranded, circular
  misc_feature 1...317
  hypothetical: NO
  anti-sense: UNKNOWN
ggggatctactgcattacggaatggctgctcgactgaggcgaagaggtgactattcgacctcccaantgcgctcgaaagggaaaatcttgatttcgatgattcggcgcttgtccatttgggtcacttgaaancggaatggctcgtacactgactgtatcgcccacatgggggagttcctgcttgatttccaagaagagcccacttagcgtatctacctcgtcccccnattcaccgaaagcattttccggaaggtcnagatagtgtcgaacatcngagacatacgtntntccttcaanaagataactgcnatccccca

SEQ ID NO: 629 - DNA (genomic), 2383 bp, PORYPHYROMONAS GINGIVALIS; double-stranded, circular
  misc_feature 1...2383
  hypothetical: NO
  anti-sense: UNKNOWN
cccgatttttatcaggacagcaaggttacttgccggatgcgaacaaaatttcaggtgaaagctgaaaattatgaacaggcagtagccattataaaaacttggcaaggtgaagacgtgatgaaccatgacgatgaagaacaggtcattttcgttgaaggagaaacgctattggatacctccgaaaatctttctcccaaagaaaacggaggtcgtccgaccatagaggtcttcgatgacaagggaaaggaaatcaccaataatttgaacccataaatatcagaggttatggctaatatatgcaccaatctgttcttctgctccacagagaacaaagagaacctgaaaacggtagaaaactacatgacggatacttttttcgggagtatcttttccgtctccaaatctttcatctgttgtcttcgatcccggactgccgataatgcaatgtatcacagtccgtattgaaggctgacgatgtgcaaaaagacctcggcagaaagtcaggtcgtccttacacgaatgttaggtcgaccttacgggccgtttaggtcgtccttacagaccgtttacgtcgaccttacagaccgtttaggtcgacctaactgaacgattaggtcgacctaaaacaaacaacaggtcgtcccgacacatcaaaatcccttcgtgcgatgggtcgcaatccggcagagagccaatgccaaacagattattaaaggttgaattttgaggatatgagttactgattgacgaatcgacaaaccctaagaaatagggattccgggctgtgaaaatagccactattggcgattgcaaacgatattctacttgtatatttttgcgaactcaaataataagaaaaaggtatggataagaaactcagattgacagggtatgtgggagtggcaggtagcctgctgatgtataccggcgacatgttgctgtattttacgacacaacccattcccgatcgggaaaaagatctgctgctttctatgggcacagtgcccttggagcgtctcattgccggagggataataggcccgttggcggcggttctgtacatcatcggattctaccatttgtttctcagggttaagaaagcgcgacgaaaaacagcctgctggatgcttgcttccctatccgtaagtataattgtaggaggtgcttatcatgccttcttcccggctttcggcatcgtatcgtcgcagggacatcccgaaatcatcgaccattttctctcctatgccggctggttgggcggtttttcttttttcttaatgggaatcggatggttgctcttttctgtattggtgctgcaaaagcagacttcttttcctcgttggatagttttcgcaacaccgttgatcaccatctggctcaatttcctttggaaaacgctgccgcaaccgtttcttctgttgatagcgggcggatggaacaatctggtgtataccctgatttttgccgtatcgctgatcacattaaaaaaacaatatcattcccgatgactatgagtgatttttcatttttcaccacgttgcaagccggatggctgaacgcatggataccttcgttcggcatggtgctgatacagtttatatatatggcaatcttccgtgagggaggaaagcgcgcggtggatacctcgtggtacacgaccaaagacaaggcgaacgcctctgtcagtacaatcctgcaaattgccatattggtgctttccgttttcgtcccgttcaagttcggtacggcatggtttcttgcgggaatggtggtttacgtgctttcgctggtgctctttgtccgggcttttcacaactatgtggcaactcctgccggaaagaccatcaaaggaggagtctatcgttggtcgcgcaatccgatgtactttttcttttttacgggaatgttcggcgtttgtatcgcttccgcctcgttgtggatgctactcgtcatgatacccttcatcattgccacacatttcctcatactgggagaagaacgctattgtgaggagacctacggagaggaataccgcgaatacaaggccaagactcctcgttatttcttgttcttttagctgctgaatagaagatgagactgttcaagaagttcataagcaattgccgcagacctgaaaacaatttctggggaaaaatgatgcttgcggggatgaactacggccataataaaatggctctctggtgcatcgacgaatgtatccgaccgtccggtgaggaggatattctcgacatcggttgcggcggcgggcaaaacatcgccaactttctgacaaggacgaaaggaaaagtatgcggagcggactactcggcgcagagcgtggcaaagtccgttgccaggaacaggaaagctgtccgagacggcc

SEQ ID NO: 630 - DNA (genomic), 1031 bp, PORYPHYROMONAS GINGIVALIS; double-stranded, circular
  misc_feature 1...1031
  hypothetical: NO
  anti-sense: UNKNOWN
gggcgggtggctatccgtctcctacaacctcgcggcggattattcctggatggaaacgggagccaacgctcatcgccggttgccccaataccggcatacggcccgtctgaccttgctgccgatcccccgtctgtcgctgcgcatggcaggcgaatataacgccacgactctggagccggggcatgtacatgaggatgtttttttcgactgcgaagcacgctacagtttcgataaggtttgggaagtatccgtttcgatgcgcaatctgttcgatcgtcgcatgtatcttatccgtcaactgacggagtacaacgctttttccaccgctatccccattcgcggtcgcgaactgcttgccacagtctttttccgctactgattttctttattcggtatagctgccgaggatcgtattgagattctttctgaatttcggtacgatttttcttttcggcgagtaatttcgtcgacgaaattactcgctgcagctatgcaaggcgaaatcttggcaacaaaattcatagaatccgacctgcaaacatgaatttcggcaacaaaatcgcttcctgcaagctgcaaacatgaatttcggcaacaaaatcgcttcctgcaagctgcaataagcaattttgttgccaagcagaccttttgcaagcttgcagcaaggaatttcgtcgacaaaattacacaatgcatacctgcggcaaggaatttcggcaacaaaatcatcaaatgcatatttcagccaagaatttcgatagagaaatttcaaatacatgctttcggcaatcaatctttgtacataaaatttccattgccgaacggcgataagaaactttgccaccgaagttgatatgtattccccttaatctttattccaatatatatgattggcaggaaaatagtttcatccactaaattacaataatcgtatgactgctttcggataaagcttaagacaagaaatatataattctatcggttttctatccacaacaaaattatttactacttttatcgaagcaaacgat

SEQ ID NO: 631 - DNA (genomic), 915 bp, PORYPHYROMONAS GINGIVALIS; double-stranded, circular
  misc_feature 1...915
  hypothetical: NO
  anti-sense: UNKNOWN
gattaagaaccaagatgaaaaaagtatttcaagatcttcctttggggtgctgttggccgttgcagtgatcggcacttttatgttcctctggcaaaagtccaaagccaaacccaaagagtaccaaatcgaaacggtaaccaagcaagacacgatcgagagcaagacggtgatcaccggtacggtagagccgcgcgacgaagtgctcatcaaaccacagatgaacggcatcgtagccgaactgctgcacgaagccggagacgtggtacagagcggagacgtgatcgcccgcctcactgtcgttccggaaatgatccagcttagtcaggccgagagccgtgtccgtatggcggagatttcatacgagcaaggcaaagaatcgtatgcccgcagcaaagatcttttcgacaaatcggtcatcgctctcgaagagttcgaggcagccgaggcaaatttcgccaaaatcaaagaggaactgtccaatgcgcgtgaagccatggagatcgtaaagaaaggtgccagcagccgtacagccaaacagagcaatacgcttgtgcgcagcacggtaacaggtaagatcctgaatgtcccggtcaaagtgggtaattcggtcattcaggccaatacgttcaacgagggaacgaccatcgcttcgatagcggatatgaacgatttgatttttgtcggcaagatagacgagacggaagtcggtcgcattcgactgggctctcccatgcgcatttcggtgggagcattggggaaagaaagttttcctgccacagtagaataccttgcgcccaagggaagtatcagtaaacggagctgtactgttcgaagtgaaagcttcggtacatattccaagcgacagagtaatccgtgccggctatagtgccaatgctgaagatcgtactcgaagga

SEQ ID NO: 632 - DNA (genomic), 4084 bp, PORYPHYROMONAS GINGIVALIS; double-stranded, circular
  misc_feature 1...4084
  hypothetical: NO
  anti-sense: UNKNOWN
gccaaaggatgggccggcggtattctcttcaatgagcaagcgaaagccacgctggatcgtttcttcgcacgacccgatacgctcagcctcggtatctgcaacggctgccagctgatggccgagttggaacttctataccccgaacacgaactcaagcacaagcttgtccacaacgaatcgcagaaattcgaaagcacattcgtcactctcgaaatcccgcataacgactccatcatgctcggcaatctggccggaagcaagatcggtgtatggtgtgctcatggcgagggtcggttcagtctcccgtacgaggagaaagcctaccatgtggtggccaagtacgaatacgacggctatcctgccaatcccaacggatcgccacaccgcatagccggattgtgcagcgcggatggccgccatctgacgatgatgccacatccggagcggagcatattcccctggcagtgcggttattatcccgaatcacaacgacacgaacatcaggtgacaccttggatgcaggctttccgcaacgcttacgagtggatagccaagcaggtgaaaaatggatgatcgtcgcccccaactgacagaggagcaactgcttttccgcatcgcactcacgcatgtaaaaggcgtgggtagcgtgctggcaaggcagctgctttcggctatgggcagtcccgaagccatcttttccgacaggaaggagctggtacagaggctaccgaaagcacctcgccgcctgctcgatgccatcttctctccttcggtcatggaggaagcacgccgaaagttggatcaagccctcaaagccggtctgaatatgtatttcatcaccgatgataactatccttaccgcttgaaagaatgtgtcgacgcccccatccttctttattccaaaggcaatgtcgatctctcgccacgtagggtgctgagcattgtaggtacgcgcaatatcacggcctacggacgtacagccacggagcgaatcgtatcgggattggctgaaaccatccccgatttgcttatcgtcagcggactggcgtacggcgtcgatgtcgcagctcataaggccgctttggacaatggcttgcccactgtagctgtattggcccatggattggacaggatttatccgagcggtcatcgttccattgctatggagatgctccgaaacggaggcttgctcacggattaccctatggggactgaaccggagcgattcaatttcgtcggtcgcaatcgcatcgtagcaggcttgtcggacgccacacttgtgatcgaatcggccgaaaaaggaggctccctcatcactgccggactggcattcggctacaatcgcgaagtactggctctacccggacgagccacggatagccgttcggccggctgcaatgccttgataagggatcaaaaagccgcgcttgtcagctcggctcaagatgtgctgacgctgctcgattggagttctaccatagacgccaaacctcagacattgaatttccgtcccgatagttggccggatacccccgtagccgaatgtcttctcagagcaggcacagcctcggtggacgagctgacacgcgctaccggactacctataaacgatgtttctgctcagcttttcgacctcgaattggacggactggtacagtctcagcccggtggcatatactccgttatataaattgtacgacgaagatgtctcccaccttgtccatactcatacccgtttataaaagggattgtcgcagactgctggaggaactgtataagcaggccgaagaactatccgtcggctacgaaatcattcttggagacgactgttccggcgaaccttacacttctcaatatatcgcttacgaacaggagggactgtgccgacttgtcagtgccgaagagaacatgggagccggccgtctgcgcaatcgcttagcagaagaagcccaaggcgagcagctccttatcctcgactccgataccctgccggcatcacccgacttcatcgaacgctatctgcgacatgcctccggcacaacagtcgtatgtggagggttcgtctacccgcccaaatcgaccaatcccctccggcaacgatatggcgccgaagtggaaagtcgatcggcggaagagcgagcacgaaaaccccactccggattcatctcaatggctttcatgatcccaagaaaacagatgcttgccaccggcttccctcccaatatgggtatggggtatgaagacatcctgttcggcgagcgtctgcgacaagccggcatccccatcctacatatcgataaccctgtagaacattaccactgcgatactgccgagggatttttggccactacgcgtagctatctggacaatctctattgtcaccgcgaagaattagccgaattggtaagcctgctcagagcatacaatttgctgaaacggctacaccttatgcgaatggtagctgctttgtggccactgatccgatcctcattggaaaagcagctcacgggagctaagccctctctcctcctcttcagcctgtataagctactatacgtagcctccctctctttggtgtgtgctgaaaaaagctgatccttagaaagatcagaaaaagcaataattatatcgaaatgtttgacctcctctccgagtgtcaactttttttcagtacacgtcagttcgtaaaaatggcggtttagcgtttggaaaaacgtggctcgggaattttttcgttttggttcggaaagtaaaaattttacgcgccacaacggaaaaattctcgctcgcgaatttcagaaaacacgaactgctgtccggtaaaatttgggcagtcaggaaattcgagataaaatcttcccttctttgccattactgttctataaagtgtcattacgaaggggaaaacagcctaaccacatataaatggcagtaaagcaaactccattattacagtatgttttgaagaatcttcatttttttaccggacggcaacaaaaaacacttatctttgtaacatagataatcactctctttaagagagaaatagatccttatggataggataggcttaaaaacgaaggttcatgcagtcggaggaatgacgggaggactgtggaacgagctttttgtaagacgatgccgaatggcttttggaagttgatttatgttgaactcaaagaagttgaagaaagatggcaaatgttaagttattactcccatatatattgaaatgggaaggtggttttgtccatgatcctgccgatgcaggaggggcaacaaacaaaggtgtaacaatagcgacttggaaaagagtcggctatgacaaagacggcgatggagacatcgatgttgaggatctcaagttgctaaccgatgatgacgtcctgaatcgagtcttgaaaccattttattgggatcgttggaaagctgacttaatcgagtctcaaaaggtggctaatatccttgtcgattgggtttggggttcaggcaagtatggtattgttattcctcaaaggatactaggtgtgcaggctgatggaatagtgggcaataagaccttacaggctgtcaatagtgcagatcccgatgagctgtttgagtccatcttcgatgcacgtcgcgagttcttagaggacattacagcaagaagcataaaaaagtacgaggatagcatcggacgcaaggccaccgaacgcgaattgctaaggcataccaacanacgtttcttgagaggttggntgaaccgtcttgaagatattaggaagctctaaagataaaagcctgcaggttcgtaccctgtcaacgaatatctccatctgtcgatctcggttgggataaagcccttcttggaaatcctaagccggccgaatgggttgtgtcataattcgatttatggcatagctcgttttcagaagccgtatatcagcaggccggcgagaccggcaagcagtatcgtgaggatgggatggagccacttcttgacggtgacaaggaaggatagcaggaacaggaggatgctccaaaggtcggtgaagttctctcgtacgactacctgatcgaggcttgccgagccggtggcgaa

SEQ ID NO: 633 - DNA (genomic), 614 bp, PORYPHYROMONAS GINGIVALIS; double-stranded, circular
  misc_feature 1...614
  hypothetical: NO
  anti-sense: UNKNOWN
gtcgtatccgaacaattggtcggagccggtttcaatgagatactcaacaattcgcttacggccggttcttattacgaaggtcttaagagccatccgagagagatggcagtggagctgatgaatccgctgagtcaggagcttaactgcatgaggcagactctgctattcggaggattggagacgctcagccacaacctccgtcgtaagcatctctccctctatctctttgaatggggtaaatgctatcgcttccatgccgcaaagcgcacggacgagactccccttgcggcctatgcagaggacgatcgcctcggcatttggatatgcggacaacgggtgcacaatagctgggcacaccccgaagaaccgacttcggtatttgaactgaaagctgtggtagaacaggtactttgccgcgtagggatcgaaaccggagcttatacgctgaagacagctgacaatgatctgtacgcatctgccatggaggtcaagactcgttcgggcaaactgttgggtacattcggaacggtatcaacggaactgatcaaacgcttcgaaatngagcaacccgttactttgccgaatgctttgggatgccctcatgagcgaatcgg

SEQ ID NO: 634 - DNA (genomic), 310 bp, PORYPHYROMONAS GINGIVALIS; double-stranded, circular
  misc_feature 1...310
  hypothetical: NO
  anti-sense: UNKNOWN
aaaagaaacaaaaagatatgtcccatttgccaatccatagaagttcgcaactcaccgattttggagtctatctgaagacaattgtatctaaaacatctgcatcttcagacagatatgccttttctcataccgacgactattatttcttcggcttcatagagggggggcaatgtcgtctgaatattgatttcaaggaatgtacttttcgaaaaggatagtctggttatcattcgtccgggacaggtacatcgcatcattgatgcttacaatctttcggcaaacttccttattattgactcgtattggtaaa

SEQ ID NO: 635 - DNA (genomic), 518 bp, PORYPHYROMONAS GINGIVALIS; double-stranded, circular
  misc_feature 1...518
  hypothetical: NO
  anti-sense: UNKNOWN
gcaatttggacaaatcacgcatgaaaaaccgttaacagccattatttcaatcagttacgagtgcaagagcaaaaattgacaattttcacctgaaaatgtgtgtctgaagagtgtttcaaaaaattacaaaaatgtttttcagacgagacccgaacagccgaatacgtgaagcaggggattatttgattacctttgaacagcagaaacttagctttgacaatatatgattacagccgaacgttatcacgacattagcatgggacaccgcgtagtggggcacgatcacaagtgcagacatctgcatggacacaactatcgtatccactttatttgcagtgcaccggctcttgattcgatcgggcgtgtagtcgatttcggtgttatcaaagagttgctatgtcagtggcttgaagatcattgggatcacaagatgatgctatgggagcaggatccgttgcttcctgctttgcgtgcgactgtgccggacgatctggttgcagtaccgttcaatcccaccg

SEQ ID NO: 636 - DNA (genomic), 9837 bp, PORYPHYROMONAS GINGIVALIS; double-stranded, circular
  misc_feature 1...9837
  hypothetical: NO
  anti-sense: UNKNOWN
ctgatttatgtattcgctcatctatctgtcaaaggtcgaaaagctcctgtgccaactcctccctatcgatggatacagcatcgaaggcttcctgtgcatacagtcgcaccagatcgggatcgttcacacgctcgccgttcaccacggcgaaggaacccgtagtcggcagtggctgatccgccacatgaggcgatcggagagcgatcgtcagagcgatggctgctgctacggaggctcctcctacactccacaggatacgtcttgagagcaagttgcgggtagcaagtttccgagtgtaggaaaggaaacgcccatccacggcacgcctgcaactgacataaccgaagagggggcgcaagtgctcccactgctcgggcagcttggccgtagcaaaatagcgacgcaggcgatcctcttctgctccggaggtaagcccgtcgaagtacttatctaacaattggccgatttccgcttcggtcggaacagcttttttgttgaaccctattcgtttcatcatcgtttgagttggagagccagtgctgtacgcagtgcgcgtcgggcgcggctcaagttggtataaacggcttcgactttcacgcctacgagccgggcgattacctcgctttcgtagccttcgatctctttcagccggaaagtcattcgctgcaacggaggcagtgcttcgatagcagcttccaccagacgcatggtctcggattgctccagtacaccttggggtgtaggggcatgatcggagaaaggcagatcgtccggtagcggttccatccgtccttctttgcggagcatatccaaggctattcgccgagcagtggtcacagccactgcttcgatgctgtcgtatccgcccagccgctctcggttgatccacagacgcatcagagcctcttgcgacacgtcggccgcagcttcctcgtcgtcgaggatgctatatgccactcgtttgagtcgaggggccaaaggggctacgctatgggcgaatgcttctacttccatgcttaagtaatcgggacaggacctccgttgcaaaggtctttatttacgagacgcagaacaaaccggaatctgtcatccgatagagcaatttttttgcccttccccgaatctcatcctttcagcaccccatcgacgatccgaagcgttacctcatccgatactactattactctcttccgataccgaactcaaaccaaaaagcattgacacatcggcttatacagggatcggttacgcgccggaattttggtgttcgtcgttcctcaaaacgtggcgcgtaattttttgcttctggtcgggaaaatgaaaaattctcacgccacaacgaaacaatttctcgcgccattttttcagaaaacacgcgccgcaatcggcgcatttttggttcgtgtttccatgacagcaggctatagacattggcgcgatcggatcgatgtcggggcgttatggctgcatgtcttatttctttacttttgtggggagcgcaggcaaacactattcgcccgccatctccattcttccaataccttcatttgttttcagtaaaatgaatcgagcacgaatcatcgtagccggcatcggtccgggaggagcatcggatattactcctgcagtgctatcggctatcggccggtccgacgtagtcgtcggctataaatactatttccgttttatcgaaccttatctccgtccggatacccactgcgtggataccggcatgaagaaggagcggcagcgtgccgaggaagcattcgggtatgccctcagcggcaagacggtctgcgtgatcagctccggcgatgccggcatctacggtatggctcctcttatatatgaaatgaaacgagccaaaggcgtggagatggacatcgaagtgctgcccggtatcagtgcttttcagaaagcggcttcgctgctgggtgctcccatcggtcacgacctctgcctgatctcgctgagcgatctgatgaccccttggccgatcatcgaaaagcgcatagtggcagcagcctncgcggacttcgtcacagctatatacaatcctaagagcgaggccgatactggcagctctatcgtttcgtagagatcttcatgcagtatcgttcggccgatacgccgtcggacttgtccgtcaggcaggccggaagaggagcaggtgacggtgacgactctcggcgaattcgatcccgaagtggtggatatgttcactgtggtactcgtaggcaattcccagtcgtactgctacgaagggcactttatcacccctcgcggctactaccccgaagaagagatcgaagccaaaggtatcgggcaggagattatgatcaagagtttccgcacgatcgagaaagagctgcaccgtcaggattggcctttagaccacaagtgggctttgctccatgccattcataccacagcggacttcgacatggagaatatcctctacacggatgccggtccggtggcttctctgtatgaaatgatcgaagccggacggctgcgcacgattgtcacagatgtgaccatggttacctccggtattcgcaagggggcactggagcgtctgggtgtggaggccaaatgctatctgcatgatccgcgcgtggcagaactggccgctcgtcacggcatcacccgaacgcaggcaggcatacgcctggccgtggaggagcaccccgatgctcttttcgccttcggcaatgcacccacagccttacaggaactggccgatctgatccgtcgaggcaaagcctctccggccgggatcattgcggcaccggtcggattcgtccacgtacaggaatccaaacatgccgtgaagccgttccgctccattccgaagattatcgtcgaaggccgtaaaggcggcagcaatctggctgccacgctggtcaatgccatactctgctataacgatgccgaacaactcagaccggggcgcgatgtgtgaagctacttacggaggagcttctcctcagatacggcgacagcgattcgtcatactcgggatgagcgatgaccctcatcctttcttccctcctgcggctatgacagctattgcttccggcaagatattcagcggaggcaaacggcatcatgagatcgtgcgcggactactccctgcggatgccgagtggatagatattacagtaccgctggatgatgtatttgcccgttatcgggagtatgaggagatagttgttttcgcttcgggggatccgcttttcttcggctttgccaatacggtgatgaatcggctacccgatgccgtggttacggtctatcccacgttcaacagcttgcagatgcttgctcatgctcttcgtatgccgtaccacgatatgcggatcgtatcgcttacgggcaggccatggcatgagttcgaccgtgcactgatcgagcgggcagagaagatcggcattctgaccgaccacgagcataccccctccgctatcgcaatgcgaatgctcgattacggctatgaggactataccatgtccgtaggtactcggatgggaaacccccaagagcaatgcttggacacgttctccctgcgagaggcagccgatcgcgacttcgaacgccccaactgcgtgatactctcggctactcggccattcgtttgcagtcgtgctccgctcggactgtccgaaagtgctttcatgccgctcaacgggcgaacgaagatgattacgaagatgccgttccgactcgtttcgctcagttgtctcgaactgcaccgagcctcatccttttgggatataggtttttgtacgggatccgtttccatcgaagccaaattgaactttcctcatttgcatatcactgcgtttgagatccgtcccgaaggtgccgaactgatgcccgtgaacagccgccgcttcggtgcacccggcatagcgtaccggatcggagattttatggaggaggatatttcttccctcgctccgcccgatgccgtttttatcggcggtcacggaggccgtcttgtagaaatgatcgctaaggtgcacagtgttatgacaaaaggcggcctgctggtattcaactccgtatcggaagagagtcggcacctcttcctcaccggaatagaagcctgtgggatggagctgctctcatccatccgactgacggctgacggcaacaatcctatcgacatactccaagcaagaaaaaaagaatagacactacccaatcatgtcgaaaccgaatcatactgccataatctgtgtatccgctgccggtctggcattggcgcggaccattgcatccgaactatcgggagagaaagagatttttgccgtcggcgcgaattttaccgactgcacggaggatgtttcctgcgtctcttccattgcggagctgatggccgaatcttttgcccgatacgatgcttgggttttcatcggtgccatgggaatctgtataaggagcatcgcgccttatgtggcggacaaacatcatgatccggccgtagtgaacgtagacagtacaggcaggtacgtggtttccgttctgagcggtcatatgggtggagctaacgatctgacgcggctgatcgcctctgccatcggtggcgaaccggtggttaccacccaaagcgaccgaacaggactctgggcattggatacgctggcttcgacctatggatggaaagccgtttccaatacaggcgacatgaatcgtcccatttcgctcttcgtggggggagcacgtacggcattggtattggagacttcggggcgaggagaagattttttggaaaggtcttgtccgcctcatgtccgccttttctactcattcgatgctgtcgatcaggcggagttcgacctcattttggttgtttctgcccggcacttggagagccggttgccgatgatctgctactatcctcctgctcttacgatcggagtaggttgtcgcaggctatgtgcccccgaaggtattgcggaacacatcttctccgaaatacggcagtcaggttatgcccccgaagccatcggtcggatagccacgatcgacatcaaagccgaagagccgcttgtggccgatctcgtacatcgtctcggagggataccgctacatatatatacgggacaagacttacagccggtggaagtagccaacccctcggaaaaggtatttgccgttacgggttgctacggagtagccgaagcctcggcacggaaagtagcggatatgggaagtcttgtgatagagaagcagaaagggcagctatcggagggtaacgattttacctttgccgtggcacagacagccgactccacccgtaccggccatatcgaaatagtgggagcgggtccaggcgatcccgatctggtatcggtgcgtggcagacagttcttggaaaaggccgatctgattctctatgccggcagccttgtccctcgcgaactgaccgcttgtgccaaagccggtgccacggtcagaagttcggctgcgatgaatctgcaagaacagttcgagatcatgtcggacttttaccgccgaggcaaattagtggtacgcctgcatacgggcgatccctgcatctacggtgctatccaagagcaaatggcactcttcgaccactacggcatgcgctatcatatcacgccgggtatctcctcgtttcaagctgcagccgcagctctgcgctcacagtttaccattcccgaacgtacacaaaccattatcctcacccgtggcgaagggcgcactcccatgccggagaaagagaagctccatctgctggcacagtcccaaagcaccatgtgtatcttccttagtgccggcatcgtggacgatgtacagcgcgaactgatgatgcactactctcccgacacgcctgtagcggcctgctatcgactgacctggccggatgaaaaaatcttccgaggtacgctccggcatttggcagaaatcgtaaaagggaacaacctgaccctgacaacgatgatagtcgtgggagaagccatagacaatcgggaagggctgtcacggttgtatgccgacgaattcaaacacctcttccgcacatgatcctactcttcggcggtactacggaaggccgtgccgcagctcgcgtgctggatgaagcgggaagtccgtttttctactccaccaaaggcaatctgcaagagatccagagtagccacggccatcgtctgacaggagccatgacggttgccgacatggtttcgttttgtcggaaagaagagatccgactgatcgtggacgccgctcatcctttcgccgaagaattgcacgcttcagtggcagaagcctctgaacaaacaggtatccccgtagtaagatacgagagacaataccctccacgcgaagaaggtatcgtctggtgtgcaaactacgatacggctgccgagcggatgcttggcgatggcgtgcagcgtctgctgatgctcacaggagtgaatacgatccccaagctggctgctttctggaaagagcgcaccaccttttgccgcatattgaagcgagacgaatcggttgctttggcagagaagaacggctttcctgcggagcgcatcgttttcttcgaaccgcatgcggacgaggagctgatgcaagccgttcgccccgatgccattatcacaaaagaaagcggagagagcggttacttccgagaaaagatagaagctgcccgacggatgggcatccgtatatatgccgtcgtacgtcccccctttgcctccttcattcattcccgtaggcgggcctgtcggtttgagacgggcggtagaacgcctcgtgccgggattcttttcactccgaagcggattcactaccggcaccacagctaccgctgcagtagtagcagccatgtaccgattgatggggcttggctctctcgccgaagctcccgtagaattgccttcgggcgaaatagtcagtctgcccatagcggaaattcgagaggaagaagatgctgtcgtatccgcagtcctgaaagatgcaggtgatgatccggatgtgaccaatggcatggcggtatgcgctacgatcaggctcaatcccgaacatgaggaagtccgcttcctgcagggtgaaggggtgggggtagtgacgctccccggcctcggtctggaggtcggaggtccggctatcaacctcgtacctcgacgaatgatgacagcagaggtacgccgactctatgcgcagggaggtgtggatattacgattagcgtacccgaaggccgagaggctgctacccagacattcaatccccgactcggcatacgggacggcatctctattatcggaacatcgggagtcgtgaaacctttttcggccgaagcgttcgttggtgccatccgtaagcaagtgggtattgccaccgccttgggagccaatcatatcgtcctcaattcgggagccaagagtgagcgttatgtaaaaggagcctatccggcactcattccacaggcctttgtgcagtatggcaatttcgtcggcgaatcactcagttgtgtagcttccttcccttctgtccgttcggtaacggtaggaatcatgctcggcaaagcagtgaaactcgccgaaggctatctggatacgcacagtaaaaaggtagtgatgaatcgggatttcctgcacgaactggctcgtcaggcaggttgttcggaagacatccatgccataatagacagcctgaatttggctcgtgagctatggactatgccgagtgcggaggacagcgatcgactgctacgaaagattgccgaacgatcttgggaaacttgccgcccatcggtaccatcggccgaattagaactcctgctgatcgatgagtccggagcgattcgttttcgtatcggtggagaatagctccggtaagccgtcagctttttttcagccaattctctcttgaaacatcaggcaagatggtgtctgatatgccacttggagcaaagccttttttctactttcctcctctatcgaatatatggacgtggaagaagccgacaaagagtgcaccgccgacgatatttccgatggtgacgggcagcagattgtcgatcacgaagctgccccagctgacggaggccccttgcagtatgccgagtggaatatagaacatattggcaatggagtgttcgaatcccatagccacgaatgccatcaccggccaccagataccgaacattttgcccgtaaagtcatgagccgaaagtcccagccagacggccagacaaaccaaccagttggcaccgattcccctaagaaatgctacgtgaaaaggcagggaggttttgtcttccgacagatggacgatggcactatgccaaggatccgcatcggcgaaacccgccaaaaggaaaaagaaaaaaggaaaaaagaaaacaaccaaaaaagtggccaaaaaaaacaacaaccaaaacctgaaggggaaaaaaacccgaaagccaacttttgatagcggcaggaatcagtacggcattattgctggtgaataactcggctccggtgagcaccacaagaatcaagccgacggggaacatcgccccactcagcagtttggccaaccccggattggcttcggccatctcgggaaaacctttaccgaccaacagggacaaaaagcctccgatagcaatgtatgctccggccatgatgcccaaccaaaatatctgataccatgtcttggcatatttgcttgcagccatgctgtaggtctgttcgagtacttcttccggatttcttaccatctcgcgctccgatctctttataattggttctgtcgaaaaaaaaagttacagctgcaaatatatatccctttgcagtctgtagtataatacctattttgccggtatttgttttgcctattccggtatcaagtgcatcgctgcgatggattcagggatggtctcaggtatagcaactttatcgggaataacatcgtatctaattaaagagacctttgcacaataacccttccacctcctcatatcgatcaaggcagacacaagcattgatttgacgaagagaggactgcttcatgcgatctctgcgaacctcaagtaatctgaaaaacacttaagaatcagctctgcggcaaaagacttcaatgaaagccctataaaatagttgcaaatagctgatagttagcgcattgatgggagcagaatcagttgacaatcgcgtcctgcatcgtgcaggaagcaagaatcagttgacaatcgcgtcctgcatcgtgcaggaagcaagaatcagccgacaatcgcgtcctgcatcgtgcaggaagcaagaatcagctgacaatcgcgtcctgcatcgtgcaggaagcaagaatcagttgacaatcgcgtcctgcatcgtgcaggaagcaagaatcagttgacaatcgcgtcctgcatcgtgcaggaagcaagaatcagccgacaatcatttcttgtttctcacctatcggcacaagcattgatttgacgaaaaaaggagtgcttcatgtgagtctctgcgaacctcaagtatccacctctgaaagaaacttggggaaatttctgtttgctcgatgtccatataccggaggtttgatctttcccaaaggcactaagaatcagctctgcagcaaaagagttcaataaaaatcccgtgtaacaagtctcattaagtgttttcgatttatatatgattgaaaatggtttgtatataaatcgcaggtcgaaaaaggccaatatatgagctgagtgtagatattcattgtcatttaatcatttgtcaaagagctttacaaagggaccgaagtctctatccatgtatataaatgctcgctgaaagcaagttctatcggcattgcaatgg

SEQ ID NO: 637 - DNA (genomic), 947 bp, PORYPHYROMONAS GINGIVALIS; double-stranded, circular
  misc_feature 1...947
  hypothetical: NO
  anti-sense: UNKNOWN
aggaaaccggcgaccgcaagcctgtgaactatgtgcttcctccgggcgtattgcgttcactcgatccccagcaagcacagagtactcagcaaaacgaacagtccatgagcctgaaagtccggacactggcaccgggcgatgcacgggctgtatataagaacacgggctacgacctgagacgttataagcgtttgcagatgtttacgcatgccgaacgccttcaggatgaagacggcacgcatacagggaatggagatctatccgtcttcatccgcttggggacggactaccggaacaattattacgaatactccataccgttgcgcctgactcctttcggtacttattcgaccaatagcgaaagcgatagagaaaccgtttggccgaaagaaaatatgttcgacttcaaactgtctgcccttactgatattaagacgaaacgcaacagggagaaagcagcaggcaatcctgctgccgacttctatcgccttttctccgaacccgaccccgaaaacacaggtaatactgtgagcgttatgggaaatccgacactgagtgaagtcaagactatcatgatcggtattcgtaataatagtactgacatcaaaagcgccgagatatgggtcaatgagctcagactcacggactacgatgagaaaggcggatgggctgccaataccaccatcaatatgcagcttagcgatttgggatcggtgaatatgcgcggacagatgataaccgcaggattcggtgctttggacgagtctctcacacagcgagccatagaagatacgcgtacactcaacttctccaccaatttggagcttggcaagttcttccccgaaaaagctcagatcagcatacctttctattactcggtatcggatgagaaagtatctccccaatacaatccctttgatcaggacattctcctgaaagatgctctg

SEQ ID NO: 638 - DNA (genomic), 401 bp, PORYPHYROMONAS GINGIVALIS; double-stranded, circular
  misc_feature 1...401
  hypothetical: NO
  anti-sense: UNKNOWN
tctgcgtgccctgacgggattggagcgcgacaagctgcgtgcagagttcgaagagatcatggcctccatcaatcatttggaagctcttttggctgatagagcattactgatggagctggtcaaaagcgaactgctggagataaaagagaaatatggcgatactcgcaaaagcgagatcatatatgcttcggaagaattcaaccccgaagacttctatgccgacgatgatatgatcatcaccctttcgcacatgggctacatcaagcgtacccctctgagcgaattcagaacgcaggctcgtggcggagtaagagccaagggatcggatactcgcgaaagaagatttccgtgganntatatctactcggcctccatgcacgccaccattatgctgttccacg

SEQ ID NO: 639 - DNA (genomic), 794 bp, PORYPHYROMONAS GINGIVALIS; double-stranded, circular
  misc_feature 1...794
  hypothetical: NO
  anti-sense: UNKNOWN
tcttttcctcctcctgtaaagaagatctttcactatcaatcacatccatcaacccacatgaagtactgtgtgcactaccatggtgagaaactttaattaaatcaaagatgactggttttgtttcatctttatatactttttctatcgcattgctcacctgctccgggatctgcatctcccataagcagaatccgatgtccttgatactcccaaataaaggcaatagaagcgatattgttgtcatccattttcgataatgggcgggatgcatatcgcttcaatatctgttcattgatcgtatcatcatttacgttctcatcttttgtctcctcgccttcttctagttgtgcaattctcatcaaagcctcatagatagtttcctccccatcatagtcttctgttttttgtttgtacagttgttgccaaaatagctttcgatattttacatctagtctatctaacgcaacttgggaaggagaaaggaaaataatcctccccatattgttggcaagttgaatcgcaggagactcatctgtaatatattctctttgccaagccctcctccattcttcttttctcaatatacattctgccagggtcagcgccttttcttcattgacattttgacttagcatatcaatcacaatgggcaactgatcatataagcctatccacattcgctttcatctgctcccgtccatggctgctcattggtaataaccctttggtagcagttatatatgaatatggttcgattataanggctggattttgagttaagcattttttatcaa

SEQ ID NO: 640 - DNA (genomic), 571 bp, PORYPHYROMONAS GINGIVALIS; double-stranded, circular
  misc_feature 1...571
  hypothetical: NO
  anti-sense: UNKNOWN
gatcgtgtacacagtctcgctatgttggtgttcgatgagcaatacaggagaaaaagtngccgaacatttttcttcctccntanggagcggtacttctacctatgtctttactgtgaaattaaaacccggacagcgcgatttctttttcgtggcaaattttcctggtatgcagactgccatggcttcgatcgtgaacaaatccgatatgaatcactttatgcaggtcctcagatatttggaccctattcattatctcaaagcaaccaatgataatggattccccatgtcgagaatgtattccaatcagacggttacgatcgggggaaccatcactcagcctttaccattcaagccggacggagaaaacaatgtgaagttgcagcgtgtggttgcaaagttggatgtgaatatcgtggaaggagtggaaaatctgcagaagattgaactttgtaatgctaatgtccactatagattggtgcccaaatcagtcagagcctattcaagttttacggncccggtagaactaaggcgagtaggtaccacgaaccaatggctttggctattatgccgg

SEQ ID NO: 641 - DNA (genomic), 645 bp, PORYPHYROMONAS GINGIVALIS; double-stranded, circular
  misc_feature 1...645
  hypothetical: NO
  anti-sense: UNKNOWN
tcgaacagctgaagcattgtccgtacgtcttcgttttggcattcgtcctgatcacgttctttgaagagttgctctgctgcggcaaactcttcgggcgagatggaacccacttcttttttcatacgctccttggcctcttcaagtgtcagatgaccttcgcgatgagcctctttgatgtcgagcatacgctccaacttacttttgtcgaggctgtcaaaagtttcatttgtttttatgacctgcatgttttttgagcaattagtgatgaataacaacctcctcgcagcttatcaaaagcttattgtggaggtatatccactttcgtaaatataacaatctcagaatatatatttgttctggtttttcatcgaggaaaaaagtgcatatgctcattacgcctcaagcaggatacgagcctgaaatgctccgattgtggtctgtgttttgtgaaaagcaggcgcgagatttttttcgttttggtttcactttttttcttttcccacgccaaaagcaaaaagttcacgtgccacacttttgggtgtcataaacccgaaaatttaggcgtgtgaacccaatcggatagggatgatacatcctatggctgaatcggaagtgaatatggtgcaaaaaaagagggacagtgca

SEQ ID NO: 642 - DNA (genomic), 2592 bp, PORYPHYROMONAS GINGIVALIS; double-stranded, circular
  misc_feature 1...2592
  hypothetical: NO
  anti-sense: UNKNOWN
tcacgaccgaagaatgccaaaaccaaattaaaaaccagaagaagattatgatcgtagttccagttaaagaaggcgagaacatcgaaagagcactgaaacgcttcaaaagaaagtttgaaaaaaccggagcagtacgcgaattgcgtgctcgtcaggcttttgaaaagccctcggtggccaagcgcaagaagatgcaaaaagccatctacgtgaagcagcttcaggttgccgaagaataaagaagaataactattgccgcagtctctttgcggctcaagaggggtgcaatgatcgagaccaatctcattcacgacaatgaatgaaacacccgacaccatcgaaagattcctctattatctacgctacgaagttcacgcgtcagaacgaaccgtttgtgactatgcacaagatttgaatcgctatgccgctttcttcagtgaacacacgggagaagtattcgagccaagcgaacgcgacaaggatgtcgcgcgcgcttggctcttctctttaatggaagccggacaaaaaagctcttccgttcagcgcagactgagcgcgttgaaaagcttttacaaatacatggtcaaaatcgggcttattgggcaaagtcctgtccgaatgctgaggggaccgaagaaagagaggccgctacctgttttcgtcccgaacaatgaaatggaaaaagtgctgaataagcccatccgtgaagatgatttcgaggccgtacgggacagactgattctggagacactgtatgaagtgggtttgcggcgttccgaaatagccactctcaaagacagcgcggtagaagacaaggccggctgcatacgtatcatcggcaaaaggaataaagagcgaatagtacctttcggaaaacgtctgcaagatatgatagacaactatcggaatattcgtgaagaaaaagtagggaaatctgatttttttttcgtttctttggatggcagaccactgacaggtgaagtggtctacaagatagttcgtacggcattggcaaacgtaccgcacctgaccaagaggagtccgcatgttctgagacacagcttcgccaccgaaatgctcaaccacggagcagatctgatatcggtcaaagaacttttagggcacgacagcctttctacgacggtgcaatacacgcatatttcgttcgaacaacttagacagatgtataacgctcatccaagggcaaaaaaagaaacgaccatgacagatgtaagaatccaagctctgcatttcgatgctaccgaccaactgaaagattttgtacagaagaaaatatccaagctgaatcgcttgtccgatggaataacgggagccgaagtcgtcctcaagctcgtcaagcctgagaccgtacaaaacaaagaagcatctatcaggctctatatccccggcgacgacttgttcgcggaaaagatagcagacacctttgaggaagctattgatctgacagtcgatgcactgaaaagacagatcgaaaaaaggaaagaacagagaaaataggacaaagaccaaaaagattcgtcgaatgtttggcgaattagaaaatgtcactaaatttgcagccgattcgcctccccttaatccgcatgaggctaaggctgtgattttagcggtaataagtcaggcaccggagcgcgaggggcagttaccagagtggccaaatggggctgactgtaactcagctggcttacgccttcggtggttcgaatccatcactgcccaccctctctgacaaaacgagggaatatcggattgccaatgtagctcagcggtagagcacttccttggtaaggaagaggtcccgggttcaagtcccggcatcggctctgattgtggttagcgttttgtataagcacaaacaaacaacttaaataaaacaaagaacttaaggttatggcaaaagagcattttaacagatcgaaaccccacgttaacgttggtacgatcggacacgtggaccacggtaagactaccttgacggctgcaatcacaactgtgttggcaaagaggggtctttcagaactccgttcatttgattcaattgataacgctcccgaagaaaaggaacgtggtatcacgattaatacttcacacgttgaataccaaacagctaatcgtcactacgctcacgtagactgtccgggtcacgccgactatgtgaagaacatggttaccggtgctgctcagatggacggtgctataatcgttgtagcagctacagacggccctatgcctcagactcgcgagcacatccttttggctcgtcaggtaaacgttcctcgtctggttgttttcatgaacaaatgtgacatggtagacgatgaagagatgctcgagcttgttgaaatggacatgcgcgaactcctttctttctacgatttcgatggtgacaatacccctatcatccgtggttctgctctgggcgctttgaatggagagcctcagtgggaagacaaggtgatggagcttatggaagctgttgacaactgggttcccctgccagagcgcgatatcgacaaaccgttcttgatgccggttgaagacgtgttctctatcacgggtcgtggtacggtt

SEQ ID NO: 643 - DNA (genomic), 1231 bp, PORYPHYROMONAS GINGIVALIS; double-stranded, circular
  misc_feature 1...1231
  hypothetical: NO
  anti-sense: UNKNOWN
agaagtcgtttggctttgcgataccctttaaagaangcgtctgcaatgtacagccatcggtattctggattggtatgccatggaggatattatgctgttttaatactcaaatatncaaaatacctccctatatccaatgaattaccaaaccaaaatatacgccaatcgccgtgcaaaggtctcaaatggcggtttagcgtttggaaaaacgtggctcgggaattttttcgttttggcgcgggaagtaaaaattttacgcgccacaacggaaaaattctcgctcgtgaatctcagaaaactcgaaccgcattccggccaattccggaaccaaattcgtgaggaatctgcttacaacgtctgttcgacgtatgcttaaggcccatcgaggtcaagccctcagtgaaagtcagaaacaactcaatcggatgatcagtaagacgcgctgcttgatagaacgtaccttcggtagtattcgacgatggttctgtggcggacgatgtcgctaccgagggttagccaagacacatacccggaatatccttgaagctatggcctacaatctcaagcgtatgccggggcttcttgtgcttcaaggcgcaaaataggcgtaaaacgccggcacctcgagggcaattgccctcgaggtgcgggaaaggggactaatccccaagctgcaaaacagacgagaatggtcaaaaacacaccgggaacaagcgagcagaaagaacagcctctttgtgcaatggtctcatcttgggattgatagatgaggatattccccttatcgtccttgtgctccatattatttttagttacaggacaaatgtagtgctttgtgccggctttggttggtctcagaatttgagaaattcaagagcagattccaatctcaaatgcaagcttttatgaataaccggaaataatacagctcaatccagatcggccatatctatcttccaggtagaatcgggaaaaatcagataggattctgctcctgactttcggagttcttcccgggcctttttcatttcctcgcggtattgtttgcgggctttttccatctctcggcggagcttttcccgctccttgcgccattcttgattttgctttttctgagccttcatatactcttggtagtatttctccttttgcttgcgatattttcgcatagcctccgagttgtcaggcttcaaaacattccactccttgcggaaataacgcgaacggccgg

SEQ ID NO: 644 - DNA (genomic), 2788 bp, PORYPHYROMONAS GINGIVALIS; double-stranded, circular
  misc_feature 1...2788
  hypothetical: NO
  anti-sense: UNKNOWN
ttccaatgttcttcgtcccgcatcatcattgtcgagatagcattctatcctgcgataaacgcccaacactatcttgcgttgtgggtcgggactatgaagagactttccgatagagactgaatacatgactaacggttcatacaacgactataaaatatattgaacgctgttttgaatgtgtaaatgcctcaaacctgatccgacagaaatgtcgttcgacaaatgaattacctttgttgggtagttataagagaaaaaggcaatgaatccgcccaaaagactgcttgtcattcaccgcgcccttgctccttaccgtatcgaactgctcaatactctgtcggcagctttcgatacacatatctacttcgaatttgcatcacctatagaacagcgattcgatgcaggcgaactagccaagcgtgttcactttcaaagcagtgtacttcctcccgccccaaaaatcccgggattgaaaaactttcgtccctatgccgcctcattggttcgcagtcttcgtcccgatgtcgttctctgtagcgaattcaatctgctgacactgaccctcactgctgcctctcgcctgttcagtccgaaaaccaagctgtatgtcttatgcgatgacaatgaacaaatggcagaagcagagctgcactacggtcgtggcctcaaacatcggatgctctcctatgtggaaggcgttattctatgtgatagccgtgcctgtgatctctatgcctctcgcttcgctacgctggatagggagcgattcgtttacctccccatcgtacaggacgaaaaggtgctgcgccccctctatgaacaggtcttcggtataggccgggacctgcgacatgctctcattcctgctggtgctcggatgatactgtatgtaggacgcttgtcagaggaaaaaaacctgccggcactgatcgataacctttccactctacccgatgatgttcatctcgttattgtcggcgacggcccgatgcagtcagccctaatgaatcaagtgcaagctacaggccatccggaacgaatcatatttgcagggaaaaaggaaggagcagagctttatgcctactatacgcaggccgattgcctcgtattaccgagcatgcgcgaatgtttcggttcggtcgtaaacgaagctctcatagcaggcgttcctgtggtttgcagcgatattgccggggcatcttgcctggttacagaaagcaacggacgtactttctcccccatgctgccgaatgctctctctcaagcgtgtaatgatctgcttggaagcatcgcacctttctgcggcgacagccttcgaccttctctcatgccatttactttcgaacgagccatancccctgtgctatccctgcttagccgatgaaaattctcctgctgaatacatncgatgcaagaggcggagcagctgtagctgctatgcgcttgatggaaaccttacaagaggccggagccgaagtcaggatgttggtattgaaccgcaatacgacaaaccccgacataatggctttacatagcggacgatgcggcaaacagccgataaataccgttttttagctgaacggcttcatatttacatgtgcaatggtcgggatagaagccggctctttcatgtcagtacggctcttatcggctatgatgtcagctgtcacccgtgggtacgctgggcagatgtcatccatctgcactggatcaatcagggattcctttcactgagagggctggagcgtctgacccgatgcggtaaatccgtagtatggacgatgcacgatatgtggcctgtaacagcgatttgccaccatgcccgagagtgcctgcgataccgaaccgaatgcggtgcttgtccgcaaatttcctcccaaaaggagaaggatttggctcgtcttgtatggaatagaaaatcccgagtaatatccctactccggcctacgcttatcggttgtagccattggttggccgatttggcacggcaaagcgcactgacggatggactgcgaatcgaatcgataccgaatcccatcgacacgaatctctttgccccgggttcacgttcggacgctcgccgaataatggatttgccgacagacagaatattgcttctcttcggagctgtacaggcggatgatcctcgcaagggcatatacgaactgtcgcaagcaatgaaaagacttcgagagagacagccggatttaagcaaacgaatcgctcttgtcgtattcggctctctccgcgatgaggtgagaagtctttttcccaattataagcttatttcgatcggttatatccgtgaaccaagccgaatggccgaactgtaccgtgctgccgatctctttgtaattccctctttagaggagaacctccctaatactattatggaggctctctctgtcggtacgccctgtgtggctttccgtgtcgggggtataccggagatgatcgtatcgggtagtaccggatatttagccgcttttcgtgatccgtccgatttggcagaagggataaccaagaccattgctctacaagaaacctcccccgaagctgttgcttcagcttgtcgctcctttgttctcaggcactactcgcgtgaagtagtatcctctcgtatgctgcagctctaccgcgaactgctctgacttgtacgaagaaggaataggaaaacatccaaaacgcaagagtcttttcggcaacttttcagcagataaatatgcagccatctttttggcaccaaaacaatacctttgtatcataatcattattaagaacgagctcg

SEQ ID NO: 645 - DNA (genomic), 563 bp, PORYPHYROMONAS GINGIVALIS; double-stranded, circular
  misc_feature 1...563
  hypothetical: NO
  anti-sense: UNKNOWN
gcgcgatgctattttcagtcgtcagcgttattggggggaacctttccccatctactacaaggagggtatgcctcacgcgctggatgaagatcgactgccgctccgattgccggaggtagataaattcctccccacagaaagcggtgaaccgccccttggaagagctaccggctggcatacagccgaaggttatccatacgaattgagcacaatgcccggatttgccggtagcacgtgcttactatctgcgatatatggatccacaaaacgatactgcgactcgtcagctcgatcggcgaatgaatattggcgtcacgtcgatctatacatcggtggtacggagcacgccacaggacacctgatttatagccgcttttggaacaaatttctcttcgaccttggtatcgtatgcgaagccgaacctttccgcaagctggtgaatcagggaatgatccaaggacgcttcaacttcgtctatcgaatcaagaattccaatacattcgtcagctatggactgctcgagcaatatgaggtgactccacttcatgtagatgtcaatatcg

SEQ ID NO: 646 - DNA (genomic), 657 bp, PORYPHYROMONAS GINGIVALIS; double-stranded, circular
  misc_feature 1...657
  hypothetical: NO
  anti-sense: UNKNOWN
aggtttccttgtaattggcttgccacatcaagagcagaagacatcttgtatccggaagcattctccttgggtgtacgcatgaagcgttcggtgtaaaccgaatcgtagaaacgccagtctgccacaggagcaacggctatccccgctttgaatgtaccatttccccgacacaaactcattagtgtggtatagccgccatagctccacccccatatgccgatacgagctgcatccacatagggcagctgtcctatagcagtggccgctgctatctgatcatcgctttcgaatacaccgagttgcatgtaggtacacttgcgccattcttcgccgcgagcaccggtgccacgcccatccacacatgccacgacgtaacctttcgatgcaaggtagtgttcccaatcgaatgaatagcgatccaatacctgctgggagttgggaccgctatactgtaccatcaggacaggatagtggcgagagggatcgaaatcaataggcttcacgatccaggcattcagttcaagacccgattgagttttgatagtggtaaactccttcgggttgtaacgataggctttcagccgttcacggagagcaacgttatcctccagtgtacgcagctctttggcacctttgcttctgaataccgaaaccacc

SEQ ID NO: 647 - DNA (genomic), 650 bp, PORYPHYROMONAS GINGIVALIS; double-stranded, circular
  misc_feature 1...650
  hypothetical: NO
  anti-sense: UNKNOWN
ggttgccgagcagaatttgggacagtttgcactctatctgcgaggcgaagttcccggattccacccgctgcagttcaaccgtgtgaccggccagccgcttgttatgagtgagatggtagaagtattcacgcaaatgatggaggagaaatgattatgtcagaaacgactaagtgccccatgtacgaggcaaaagactataagagcgatcagtatgtgcgttggtgtccgggttgcggcgaccacgctgtggtagtaaccctccagaaggcaatggccgaaatagggatccctccccatcagacggcggtaatgtccggtatcggatgttcttcccgtttgccatactatatgaacacctatggcttccacaccattcacggtcgtggtgcagccatcgcgaccggcgtgaagacagccaatccggagctttccgtatggctcgcatccggagatggtgacagcttggctatcggcggcaaccacttcattcatgccgtgcgcaggaatatcgatatcaatgcagttctcttcaataaccgtatctatggtctgaccaaaggccaatactctcctacctcagctcgcggattcgtatccaagagttctccctacggtacggtagaagatccgtttatccccgcagaactggt

SEQ ID NO: 648 - DNA (genomic), 311 bp, PORYPHYROMONAS GINGIVALIS; double-stranded, circular
  misc_feature 1...311
  hypothetical: NO
  anti-sense: UNKNOWN
tcgttcgttcaagggtcttcccaaaaataaacagttgatcaagtatctgagcgaacccggcatcaagagctccatgctgaagaccgaagaagcatacatggctgaaaacatgaggaatatgcatttggtcacagacgaattgtatttcatcatagatgaaaagcgtaatagcgtanagcttaccgagaaaggtatcgaccttctgacgtcccgtacagatgacccgaaattcttcgtcttgcctgatattgcagctgagttatccgctttggacaatatggaatccgatgcataaaaacgttgcgaagcca

SEQ ID NO: 649 - DNA (genomic), 1045 bp, PORYPHYROMONAS GINGIVALIS; double-stranded, circular
  misc_feature 1...1045
  hypothetical: NO
  anti-sense: UNKNOWN
gacaaggacacgaagcgcttctggttgttgccaagagggccgaagccaaatcgggacttgtgcaagcaattctattataagacgacggcatcgttcctatcgtgcactggtatggggacgtttcgactacccgatcgggaaccattaccggcaatataggacgcgacctgaaagaccgcctgcaaatggcggtattccctcccgatggagatattggcaaaccggccgtaacgcattatcaggtcttggaagaactggcatacgtcagctggatagaatgccgtctggagacagggcgtacccatcagatcagggcacacatgaagcacataggccatacgttgtttgctgacgagcgttatggcggcgatcaaatcctgagaggaaacaatacggccaattaccgccgattcgtgcagaactgtttggctatctgtccacgacaggctctgcatgccaagacattaggctttcgccatcctgtcacgggagtggagatgcagttcgactccgatatacctgccgatcttaccactttgcttgagcgttggcgtacgtttatcgcctgcatatctgcaggacaggactatatctgaaccgattcggctgatcctcatacaaatagtacaatactttcccctacatattaaataaacagaacgatgaaaaaaccaattgtggctgtcattgcaggcggttattcgggcgaacattcggtttcgctcaaaagtgctgccggcattctgtcctggctgggaagcgagcctttctccacctttcttgttctgatcgaacgtgatcgctggtcggtaagagtatcggagcagagagaggttccactggataagaacgatttcagctttgatctcgatggcgaacgaatacggtttgactatgcttatatcaccatacatggaactccgggagagaacggtctgcttcaggggtatctcgacatgatcggcatcccatacaatacgggtgacncgctcgtcgaatccctgactttcaacaaatatgtgtgcaatcgttttctctccggctt

SEQ ID NO: 650 - DNA (genomic), 5595 bp, PORYPHYROMONAS GINGIVALIS; double-stranded, circular
  misc_feature 1...5595
  hypothetical: NO
  anti-sense: UNKNOWN
ccgacacccagtagtaagaattgacgttggtcatgtcgaacagattgaaagaggtcagcccctatgtaggccccttttactcccattagccatttgcttcggccggcaaaggagtcatccgggtcgagccatttgtacattacccccagatcgacacgcttataggccggtgcggtaaaggccggcgagctaagccctttgctcggattgagctggggcaatcctccgcttagtgcagcccgcagggtggctgtgatgcgtttattgcccggcacgtactcctgaaggaagaaggagaaattgtaagtgggtgcgttcatcagtggtaaagaaccgtagccatccagtttctgacgggcttttataatggaagccgtcagccacgaatccactccgggtaccagttcgccgaagagcttgagatcgatacccgcagcataacccgaaccgatgttttcgcccagatagcggatcttcacgttctctattatatacgggttgatgttgaacaggctcttgtagtaagcctctgccgtaaacttgtattttcgcccccccatttcgaaggtatagtctgctcctgcgagaatgtgaaaagctccctgagagcggatcttctcgttgaggacaaccacgttattgccttcggcatccttatgcgtctgccttagctctttgtaaaacggtgcctgataataaagtccggcggctgcacgcagtaccaaagccgggttgctttcgggagaataacccacgctgatacgtgggctgacgagcaactccttgttgaagctccaccacgaagctctgatacccggaatgagagaaaatgtacctcctcccatgctgaagttgaatcgatcctgtacgaatgccgacaagcgcgttcccctcatctgcgtatcggcatataggttattgtacatcagcaatacggtctccgagtgaggtaggttgtatcctaccgaatccctccgttcccattcgctgatatggtcggctattttctccatctgtgccgatacgccggcttgcaggcgatgcttctcgttcagcttcatctcccctctgtaacccatgttcagcacgcggtagctcagcctgttgcgcgcatgctcgtgattgcgcccgatgcccaagccgttggagttctctgagcccgaagccatcgaagcagttccgtccgcccccagctgcacatcgttcagaaagtattctccctgaatatcgtaggtctcccgttcgttactgttgaaggccgaaagcgtaaccgtatgccgctgtttgtcgtccggcacgaagttcatgctgaaggcaccgaagtaggtcaggaaacgatcttgttcctgaccgtcgaaaaagatcttcaactttttggcatcgctcagtgtaccgaagctcgtctcacgggtctgagggacaaacttgtagcgagtttgcgaaatattgccgaggaaactaaccgacagcttggggctgaaacggtacgtcatgaatgtctgtccgtccgcatagatcggatcgtattcggctttcgtgtccgtagtgcccaagagcgatttggcactcttgtagcgtacacccgtgatttggctgaaggctccggcactgctgccatagtaggcactcgattgtagcatcccgaggagtaccgctccttccttctcctgcggttgcttgtagcgaatatccagtacggaggacatcttgtcgccatagtcggccgtgaaccctccggcggagaactgtacggattgtgtcagatccggattgacgaagctcagaccttcctgctgtgcagagcgaaccagcagcgggcgataaacctccactccgtttacatagaccatattctcatcgtagcttcctccgcgaaccgagtattgcgagcttagttcattgttctgcgttactcctgcgtaggtactgatgagcgattccacccctcccgtaggccctgcattgacacgaaggtctcgggtattgacgcgctccatcgtgttgagtctgcgttttgtggcctgtaccgtcacgctcgaaagctccatctcggcctctgccaaacgaacattcagccgagtgtccttggtcagagacggaaagctgcgacttaccccttggtaccccatggagctgaactcgatcgtgatgctgtccgtcgtggccttcatccgaaactcgtagtatcctttcagattcgtcgatgcgcctgtccccgtaccacgcactttgactccggcgaacgggatcggcttttccccacggtcgagcacatagcccgataccctgacgccttgtgccatagctgcctgagagcatagcaggcagcatagcagaatgaatgacaatctgtatataccgttgagctttatatacttgttctttcgggnaatagcttccttcatgatctattaacggtatttgagggagaaaatcgtttgtccctttctctccttttcccggcttaatgagccaaaatccaatggaacaaaagtaatacctaaagagattcgaaaacaaccatccctaaaaaacatcagtcgtatgtgccatgatgctacaagaaaaaggcttgataaagaagtttttggatcagatagagaagccgtcgaaagcaatgtgtgtccataccgacgatttcgccaagcattgttcaggtgcaggattctctgcaaatacgagaatggcaaaagcatcagtccaaaggcaaatagaaaaatctctgtgtgtgggggggatgtgaagaaagaagaagacgaatcgactttggggaattacaagacctgtaattttagatgcccccttatcgctttcgaagttgagcggaagacgggactcgaacccgcgaccctaaccttggcaaggttatgctctaccaactgagctacttccgcagtctatcccgaaatggaacttcggtagaaaaagaaaacgaaaccatgtacccggagcgggacttgaacccgcacagccgataatggccaaaggattttaagtccttcgtgtctaccattccaccatccgggcccttgatttcaataagagcggaagacggggctcaaacccgcgaccctcagcttggaaggctgatgctctatcgactgagctacttccgcgaccttaacgcttgtttttacaaaagtgaagagtgggcagtgatggattcgaaccaccgaaggcgtaagccagctgagttacagtcagccccatttggccactctggtaactgcccattgttcttttgcgattgcaaaggtagaaacaaaatccaattatacaacagttcgctcggcaattttttctgccatctctttacgaaccggaaaaacatcatccatggggccaaaagatgtggttcgagaattttttcattttggttcgggaagtaaaaaattctcgcgccaaaacgagaaaaaactcgttcgactttttccaattttacgagccgcaatcggagagactccggtgcgtaaattttcaaccgatggtttgtatcgatagaacaaaatcagaatcatttgcccatctttcggtctgatgggattatgcatggagagaggacaatcgttagctttgcagtccaatcgaaacagaccttatatgatacgcatcatacaaccgatcttgcgaagcgagcgaagacgcaaattgggacgcgaatacttcattcttcaccgcaagttgtcggactgcttttcttcgatcaaatgggctttaccagcgaagggagacaattctcatggctgttcctatccggtcatggagcatcggtcgctcattatgcgccggctgaaggatgtggatatgtacatgcaagagaacaaacgaaccaatctgcgactggccatctccaagctgcacggtatgatcatacgtcccggagagaccttctccgtctggcgtcatgtcggtcgtccgactgctcgcaaggggtacctcgaaggtttggtattgagtcaggggaagatcggcaaaggagtgggaggcggtctctgccagcttggcaacctgctcttttggatgtttgctcatacgccgctgtccatagtcgagcgacacaggcacagcttcgatgtttttcctgacataaatcgcagtattccgttcggagcaggagctacgctttcgtataactatatcgaccttcgggtcagcaacaatacgccgcacacctacaggctggaactctggctggacgatacgcacctgaacggacggatcagctccgatacggagcagagggatcgttatcgcatcgaggagacggatcaccgcatagagcatcagagttggggtggctatacgcgacacaataagctggtacgtatcgtcactcgtgccgatggcagcgaatataccgagccgtttgtggagaatcatgccatcatgatgtacaatcctttgctctcccctccccaaaatggtgcaagcacctctttccaaaggtgatctcggcagttcctctctttggctctttttcggagagggactgagaataaagcatatatttgtacggaattagaataaaaaccacaatcctcataatttacagttccctatgagatacggatttatgaaggtcgcagcagctgttccttttgtgaaagtggccgattgcgaatacaatatcgagcggatcgaccgcatggtacacgaggccgatgccaaaggtgtagagataatgacgttccccgaattgagcataacgggctattcatgcggcgacttgtttttccagcctttcctacaagaacgagccaacgaagccttgtgccgattggtggagcaaactgccaatacgactgtcatggtgatagtggggatgccgctgcgcgtggaagaaaagctgttcaactcggctgtggtattccagcagggaaagatactcggtgccatccccaaaacttacctgccgaactatcgcgaatttcaggaggctcgctggttctcaccggctcataccctgcagtactcgaccatcagtatcggtcagcacagcgtacccatcgggcggaacctcatattcaaatgtggcaccgtgggtgtcggcatagagatttgtgaggatatgtggacgcctttcactccgggtacacgtctctgcctttatggagcagaggtgatcttcaacctctcctccagcaatgaaaatgcaggcaaacattcttacttgagatcgcttatcagcggcctttcttcacagggtatctgtgcttatgtatatgccagcagcggatacggcgaaagctccacggatatcgtcttcaccggcaaagcctttattgccgaggccggagagatcgtggaggagatggagcgattccgctatgaggaaaggatgatcatcagcgatatagacgtttcgcgtattcagacggagcggcttatcaatagcagcttcaaggctgccgttaccttccacacccatgacgaaaagttcaatcagctgcccttcaaactacgtagccggcaggagtctcttccgatgaccgcgccgtgtggatcgcaaccccttcatgccggaggacaaggatcgtaaggagcgttcgcgcgagatgatcaatatccaagtgtgcggctcatgcaacgcctgct

SEQ ID NO: 651 - DNA (genomic), 1211 bp, PORYPHYROMONAS GINGIVALIS; double-stranded, circular
  misc_feature 1...1211
  hypothetical: NO
  anti-sense: UNKNOWN
ggctcagacgaggcagatagcccatgcacagctctttgccggagaagaggggggaggggctttccctttggctttggcctacgcacgctatctcaactgccagatgccgaccgatacggatgcttgtggtcattgtccgtcgtgtgtgaaatacgatgcgctggcacaccccgatctgtttttcgtctatcctgtcgtaaacgcgtcctcttcgcctgcaccgagcgatgactacatccgtcagtggcgcgagatgctcgggtcggaatcctactttacccctgccgactggctcgaatacatcaaagccggcaacagccaacccatcatttacagcaaggaagccgaagccgtggagcagaaactcagcttccgcatctatgaagcctcgtatcgtgtggtgatgatttggcaaccggagcggatgaatgaagccatggcaaacaaactgctgaagctgatagaggagccgcccgagcatacgctcttctttatgatcagcagcgagccggacaaggtgttgggaacgatcaggagccgtacacagctgatcaacgtgcgcttgctgcacgagatcgaaatagtggaagccttgtctcgtaacaatcagggaaacacggccgacatcatccgcatagcgcatttggcagagggcaactatcggcgagccatggatctctatcggggcgaatgggctgatcgcgacaactttgtgcttatgggacgaatgatgggtagtatcatcaagggggatccctccaagatgcgtcccgtggcagatgagttggccgctctcggacgcgtcagccagatcgggttccttacttattgtttgcggctctttcgcgagttgtatataagtagagtaggggttgcaaaactgaactacctctctcccgaggaagaatccttcgtcgatatgctcagtggaggcattacgggacagaacatccgaccggtgatggaggaggtggagctggctatccgtcatattcgtcagaatggaaacggtcggatgatttttttcgatctcctcctccgccttacggccgctcttgcccctgctcttcgtgccaaaggccttaaataagcaaccctgtctttccccctttatacggcttgtacatagagggagcgcgccctgattgcatcaccatttcactggatttttgtcgctttttcacatccgttcaaggcgtatattgcttttt

SEQ ID NO: 652 - DNA (genomic), 479 bp, PORYPHYROMONAS GINGIVALIS; double-stranded, circular
  misc_feature 1...479
  hypothetical: NO
  anti-sense: UNKNOWN
gtttgcagtgttaaagtagaacctacagataggttttctgttgttgtcatctaaaaggacgctaaagtaagactgagtgtctcttgaggcaatacggtcaatattgatatatttccggagaattccttttacaatcatatatgcttccatctctgcttcggtcgttacaacaagaggttcattagaatcatcttgctcttgtgattgctcctcactcgcagcgacttctttacttttatccattaccgntttaaatcgagcagtaatcaaatcattaataacagatttgaaagacttctgtgtaagatccttgaattgttcaaaaatctttgctgtaataattccgtcataaacttggtttgcgagcattcttaccaactgntcagagggctcattcattttctgcaagtatcaaaatctttcaactctttcatataccttaaggtcactagccagtaccttagaatcttatcaaccat

SEQ ID NO: 653 - DNA (genomic), 2591 bp, PORYPHYROMONAS GINGIVALIS; double-stranded, circular
  misc_feature 1...2591
  hypothetical: NO
  anti-sense: UNKNOWN
actggcgacgcagaaattccacggagtcgtccgtgnagccattatcgggctacgataagacgagccgattgtcgcggtgtatgtgctataagagagggaggaactcntccagcatcttacgtccgttccagttgagaatgatgactgcagttgtcatagttgtcgggtattatgcaatcggggacgtttccagcggcggtggctccaaagccattgcgacggatcgcgacggatggtggtctccatcaggcggacatattcttccgtaatgcttccttcggggctgtcatcctgaggatggtgcaagagcttgatggtaccggtgaagacatcgtgccccgttttctccacatccatgtagactaccggcagagagaacttacggccgagcttctccgtcccattgaagaaagccgtttctctgccgaagaaggtagtccagtatgagccggcataggccggactttggtcggcgatgaagatgactagtggagtctctgtcggaataggattgcgaacgagtcggagcagttcacgtggcacgtcgtgcttggctataccacgcgaaccgaatcgctcccgtatgcgatgcatgagccggtcggaagaagtacttttcaacgggcgaaagatctgatagatctgtaggcccaaatctttgatgatggcctgactgccggaaaagtactcccagttgccgaaatgccccatcatcaggagaatggcagggtgcccttcggctcgtaagcggatcaggacatcgagattttcgaatgagatgtggcggcggagttgcgcctgtgaataagtcagaagcttgaaggaactcaagatttgatacgtgaaattatagtaaaatcgacgttcgatccggcgtatttcttgtaaagatttctcggggaaacagcgagtcagattgtcacgtaccacctttctccgatagcgaacgacggtatgcagcagccctgccaggatacgactctgcaaccgcaccatccatagcggtagcactgcctgcatatacgtcaggcctaacagcaaataataggaaagggaaagtgtcgctttcatgggaatatggtatcggctgtctgcacatattctccgcttggatcggttttgcccaatacgatctcttccactttaccaaccgagtctgcggcatagggagccgctacgcggatgtagttctccgtaaaaccctgcatcagaccttcatggcaaacgtcctcccacagcacccgtcggtgcgtaccctcttgggagcgatagaactcggcaagccgaagatcggacagatccagcagcctgcggctacggcgttgcttctcgcgagcatctaccttataaggtatttgcagtgcctgggtgccgggacgctccgaataggagaatacgtgcaggcggctgaaagaaatcttgtcctgcaggaagctgtagcaatcctcgaagaattccggtttctcacctctcgttcctacaatgacatctatcccgatgaaggcgtggggcaatgccctgcggatatgctccactcgctcccgaaagagagccgtatcgtaccgacggcgcatgagcttgagcacatcgtcggatccgctctgaagcggcatatggaaatgtggagcaatacggtgtgccgaggcacagaagtcaataagttcgtcggagaggagatttggttcgatagaaccgattcggtatcgctcgataccttccacttggtccagagcacgcaagagatcgaggaatgtctcccccgtactgcgcccgaagtcacctatattgactcccgtaagtacgatctcctttcctccctctgcggctacggcctcagcctgtcggacgagagactctatcgacccgtttcggctgcgtccgcgagctttgggtatcgtgcagtaagagcagtggtagtcgcatccgtcctgcactttgaggaaatggcgtgtgcggtcgtccgccgaacagccgggttgaaatttgcgaatatcctttgtgggggtcgtgagaatagtctgctcggcaaagccctgtatcggtctttggctgagaatacttacgaggtcgagcttctcatcggctcccagtacgatgtctactccgtctattcgagctatttcctccggtttgagctgggcatagcagccggtgacgatcatcaacgcaccgggatgctctttatgtaacttgcggatggcattgcggcatttcttatcggccagctccgttacggagcatgtattgatcacgcatatatcggccttttcgccctctcgcacagggcgcacaccctgctcggcgagagcttttccgatggtcgaagtctctgcgaaattcagtttgcagccaagagtcaggaaagccgcttttttgttttcaaagatgaaagcatctgtcataccgcgcaaatttactgctttttgagactgtgggacagatatttcagggcaactcacagggcaatcgcatttgaactgtcaacacacttataaacctaactaacgattgctacactcggttatcaaacaagtacgaattaatgggacctttgcacaacaagcaggcnccttttggttattcttcttatg

SEQ ID NO: 654 - DNA (genomic), 1646 bp, PORYPHYROMONAS GINGIVALIS; double-stranded, circular
  misc_feature 1...1646
  hypothetical: NO
  anti-sense: UNKNOWN
ccgattttttcaaatctcccgagactgaatattttcttacatttgtcgcccgatgaagctctctgtcggaagttggatgtcgctgccaagagagccgattgcttgaatagaactacatggataatagactataacagaacatgtgcaccgaacacatttatacccccgatctttccggccgatcctttcgcgcccataacctaccacgccatctcgatatttggacaaacagcatatatccctatgacgaataagtaggaataactcctcttatactcctccaaaggcataaggcacccgcacggttcggccacgaatcgtgcgggtgcctcttttatttcagcttccgaaagggcctttttcggtcttcgatttatatacaaatgagtttcgatctatatataaattgaaaatgatttatatacaaatcgaaaacgatctatatatttatcgtaaacagtttgtatatagatcgttatcttgtctcccataaaccatattttgacctgaaaaagttcgtttcttcatattttcgacatcaaaatccgttccctttcaggtgcttatttagaatcattccaaattccgcttcgttgttgaaaactaaaaaattttcaaacgcgatcgtcctgacaggctgccccggggccgacgcattaaatcggttttgcggcttcattcgagcgagtttcttctctgaatacgagggattgaggacttcatattggcctttaagggggaaacgatatgttgccggcggtaactgacgtgtactaaatggtcgtctgacacacataaaatgaatgaacaaaagtgcctgcttattgtgcaaaggtcccattaattcgtacttgtttgataattggatgtagcaatcatgagctttagatgtacgttagtggctgaaatgcgattgccctgtggaatatgcatcctgctatatctgaaatgtgttatttttttatctttgtgcggactttgttcagagctgcctttttcctattgggatcggtggtgatgattaaaagggaatcgggtgaaaatcccgagcagtcccgctgctgtgaaccttgttaagctttcggcatttatatccactgtccgttctgtgcggatgggaaggagtcggaagtatggggtgagccagaagacctgcaaagtctttgtctgcggcttcgaggaaaagccgggagagaatgcacttgtggtcaatccgactttactgccacaaggatccgtttctttccctttcaatcccccgaggaaaattttgtttccgacgcagcggaaacgatccgattcttttgctaggaattggagtgtattgtgagcggacccttatggtcttgtcttggcgggatgagctccgcacaaggcagacctaagggtcttatcatttttatcctatcattcttttttatagagtttctgcttcccttcggcgaatctacaggggtatgattattatcccgaactatgaaatctattgtttttcggatgtcacgacctaaataagtactatttttgtggggtttcgaacgagactttggtttccgttagaatttataaattgataaaaccacatgaaaatatgcgacatgtcgcccttcggcttcattttcttgtcatagaaaaagtcttgagcc

SEQ ID NO: 655 - DNA (genomic), 632 bp, PORYPHYROMONAS GINGIVALIS; double-stranded, circular
  misc_feature 1...632
  hypothetical: NO
  anti-sense: UNKNOWN
cttgtaatgttactgttgccataactgataatgctgttagaaatatttttagactcattgtaataatatctttattcctaaaacaaggagttcgtcttattgttcatcgtacacgaatcatgctcaacccgtcgcgcatcggaactatcaagttctccacacgttcatccagcaagaccatttcgttgaagcgaaggataccctgtgtctggctatcggtcggaagaggctcggccaccactttaccgtcccaaagcgtattatcggccaggatgagtgctccgggaggcaggtggtctatgatcatttcatagtaaagggtgtattgtctcttgtctgcatccatataaatcagatcgaagcgttcgttcttgaccaagtccggtagtagatccaaggcctcccaatatgtaatctgatcttacccccaaaatccgatgcctccagatagcggcggatgaagtcctccatctcgtcgtcgcgctccagtgtgtggagcagtccgtccggagtcaatcccctctgccaagcagagagaggcatanccggtataggtgccgatctccaagatccggcgtggcctcatcagatgagagatcatcgacaaaaaacgtccctgcaggtgtcccgga

SEQ ID NO: 656 - DNA (genomic), 656 bp, PORYPHYROMONAS GINGIVALIS; double-stranded, circular
  misc_feature 1...656
  hypothetical: NO
  anti-sense: UNKNOWN
gagctcgccaaaaatttgtagaacctatttcttcatcaaggtactctattggatttatcaaccaattcgctttgaacatctctctcaagcgatccgcattacggctcgcttctgtggagaatactgtctgattagcatatactttgtttagcaattgaactaaattagctgcagaatacatccctttttccaatagttcatctgtttggattaatgcatcatttggctctaatttttgtgatgggccgacattttgataataaggggctggaaataaatttccctcgcgcataggcctgattatatataagtctccaatctttctcgaaaaccgacacaaacgaccgcatctttgggtcaatcgatcaataggacaaagatcagaaatcattatatctgcactgatattcacactcatttctccaatctgtgtcaatatggcaaccccatttgctcgatcattatcccaagcgcttctccctaatctaagaagcaattgtgcttccttttcaattttatctgttcagtatacctactatgataaagtattacttcttcttcatgaccgttctccaaaaaccattgatagtatgcttgtgctctatcgacagtatttgcgaaaataatcgcactacctctatcaaggcataatggta

SEQ ID NO: 657 - DNA (genomic), 806 bp, PORYPHYROMONAS GINGIVALIS; double-stranded, circular
  misc_feature 1...806
  hypothetical: NO
  anti-sense: UNKNOWN
acatgacgtagtcaatatcctccggcttcaatccagcatcttcgatagcgtttgtcataaccagcttggctcccaacccgtcaggatgacttgccgtcaggtgatatgcatcggctgaaagacctgttcccaccaattcggcatagatgcgagcaccgcgtttaagagcatgttccagttcttcgagaactatacatgctgctccttcacccattacaaacccgtcacgactggcactgaaggggcggctggcctcttgtggagcatcgttgcgagtggagagagcattcattgcattgaaacctcccactccggcagcgcaaatcgacgcctcagagcctcctgcaatgattacattggctttgcctaagcggatcagatggcaagcatcgatcagagcattggtagaggaagcgcatgcggatgcgatggaatagttaggaccatggaagccgtatttgatcgagatctggccggctgcaatatcggagatcatcttggggatgaaaaacggattgaaacgaggcccgttctccggattgtagtcgcgcacttcactttcgaaagtcgtcagaccaccgattccggcagaaacgatcactcccacacgattcttgtccaattggtccaaatcgaggccggagtcttttacactctcatcggccgctacttgtgcaagttgcgcgtagcggtctaacttacgcacctccttgcggtcaaaatgttgcaaagggtcaaaacccttcacttcgcaggcgaactgcgttttgaacttggaggcatcaaagagcgtgataggtccggct

SEQ ID NO: 658 - DNA (genomic), 665 bp, PORYPHYROMONAS GINGIVALIS; double-stranded, circular
  misc_feature 1...665
  hypothetical: NO
  anti-sense: UNKNOWN
tagaggatccccatcaagtttggctccttgttcgacgaagacactaatcaagataataacagatagatatggaagacgaattgctgaactttaattatacggattccggtttgcccgttattatcaaggtaatcggagtcggcggtggtggtggcaatgctgtcaaaaacatgtaccacggcaaggtgcgggatgtatcgttcctcctgtgtaataccgatgtgcaggctctcgaccgaagcgaggtacctgatcggctggtactcggccgtgaggtgaccaacggtctgggtgccggtagccgtccggaagtggcacgacgagctgcagaggccagcgaagccgacatacgcaagatattggatgatggccatacccgtatggtcttcgtaacggccggtatgggcggcggaacgggtaccggtgcggcccctgtcatcggtcggatagcacgtgaactcaatatcctcactgtcggcatcgttaccatcccattcgttttcgaaggcaagcgcaagattctgcaggcactcgaaggggtggaggaaatgcgcaaaaacgtagatgccttgctcgtggtcaataatgaacggctccgcatcatatacaaagatcttaagctcgacaatgcttttgccaaggcagacgagacactgaccaacgca

SEQ ID NO: 659 - DNA (genomic), 917 bp, PORYPHYROMONAS GINGIVALIS; double-stranded, circular
  misc_feature 1...917
  hypothetical: NO
  anti-sense: UNKNOWN
gtgctgatggtcattttcttccttgctgtcggtttggagatcaagcaggagattttggtcggcgaattgtcttctttcaagaaagctatgctccccattgtaggagccataggagggatgatcgtccctgtccttttcttcctgctggttgttcatgaaggccctggtgcaagaggtgctgccatccctatgtctacggatatagcttttgccttggcggccttggctgttttgggaagtcgggttccggcaagcctcaaggtattcctgacggctttggctgttgccgacgatataggtggtattatcgttattgcgctcttctatagttcccatatcaacatcgggatgttggccattgccttcggtatcctattcatcatgtatttgatggggcgtatgcatgtgagcaacttagggctttacttcgtctgtactttctttgtttggctctttttcctacagaagcggtatccataccacaatagccggtgtgctggcagctttcatgattccggcccgtcctggactacatgccaagaatcttcgtgccgagatgcgttcccttttcgaggcaatgcccaatgacaagatacgacaatcaggtagctctctgatcttgagccataaccaaatcaacgtaatcaactccatgcgtaagattgcgcgtaaggctataagtcctatgcagctcatggaagagtatctcagcccgatagtaggctacttcgtcttgcctctctttgcctttgccaatgctggcatcacgctcggaggagtcacggcagatgccttgnggggcgtgcccgatggcttgattcttgggcttgttgtcggcaaacctttgggattacttttttcacctatggtttgncaagatgaagctctgcccttggccctgaaggaatgagcccgct

SEQ ID NO: 660 - DNA (genomic), 623 bp, PORYPHYROMONAS GINGIVALIS; double-stranded, circular
  misc_feature 1...623
  hypothetical: NO
  anti-sense: UNKNOWN
aagtcgctgcccatgaagtagtctttcttggccgatgctccactgatgcgacgggtcttcttcatagcaggcaggtagagccatttgtcatcatccttaccgatctgatcataatcccatgtgaggaaaccggtgcctttgacatcgcccggatagaggaaaaacataatagtcttcttgtctttcttatccttacccatgtcaatggagtaggaaatgagtttgcgctcacgtacggctcctcgtttattaatgagcttcatagtgagttcggagcgacgcgtatcaccgtcggggcggtcttttacgcgctgtgctatgtcgcgccctgtctgggcgtagatgctgaaagagaccattgctaccatggctgtcatgagggtggtctttgccaatcgtttcatcgttttctgtttttgttagctgttctatatttagtcttccccatctttcaggaaggcaaaaatgtacaggcatatgcctaatcggtaaccgtgttcgggagagattggtctgccgtcttttttgaaaccgatacggcaaaatcttctttcccgaatattcggaatcgtcggaacagggagtggcgtgatgcagaagtctgccaaaagggctgtgaacat

SEQ ID NO: 661 - DNA (genomic), 3274 bp, PORYPHYROMONAS GINGIVALIS; double-stranded, circular
  misc_feature 1...3274
  hypothetical: NO
  anti-sense: UNKNOWN
ccgcaaatacttcgagaaggacaaggctctggaacgacgcttccagatggtgatggtggacgagccggacgagctaagctccatctccatcctccggggtttgaaggagaaatacgagaatcaccacaaagtgcggatcaaggatgatgccatcattgcggccgtgaagttgtcgcaccgctacattacggagcggttcctgcccgacaaggccatcgacctgatggatgaggctgcggctcgtctgcgtatggaagtggattcgctgccggaggagctggacgagatctcgcgcaggatcaagcaacttgagatcgaacgcgaagccatcaagcgagagaatgacgaagagaaggtacagttcctcgacagggaaatagccgaactcaaggagaaagaggcctcggagaaagcccaatggcagaacgaaaaagatcggatcaatcagattcagcagctcaagatagatatagaggagctgaagtttcaggccgatcgtgccgaacgggagggcgattacggacgagtggccgagatacgctacggactcatcaagcagaaagagacggagatcgacacgatacagcagcagctgcacgaattgcagcgtggcggctccatgatcaaggaggaagtggaggccgacgacatagccgacatcgtgtcgcgctggacgggtatccccgtcagccgcatgctccagagcgagcgcgacaagctgcttcatctggaggacgagctgcacaagcgcgtgatcggtcaggacgaagccatccgtgccgtggccgatgccgtccgtcgcagccgggcaggccttcaggatcccaagcgtccgatcggttcgttcatcttcctcggtactacgggggtgggcaagacggagttggcacgtgccttggccgaattgctcttcgatgatgagagcatgcttacgcgaatagacatgagcgagtatcaggagaagttcagtgccacgcgtctgatcggtgcgcctccggggtatgtgggctatgacgagggtggccaattgacggaagccattcgccgcaagccttattccgtggtgcttttcgatgaaatagaaaaagctcacccggatgtgttcaacgtattgctgcaagtcctcgacgatggccgcctgaccgacaacaaggggcatgtggtaaacttcaagaatacgctcatcatcatgacgtcgaacctcggttcggacatcattcgcgagcggatgcagaacctcacggcggagaatcgccggtccctcacggcccggacggccgatgaggtgatgcagctactcaagcatacgatccgccccgagtttctgaaccgtatcgacgagaccatcgtcttcacgccactgaccgagaaggagatctacgagatcgtccgcttgcagctcgatggtatcgtgcgccaactggccgataacgacgtggtgctccactatacggaggctgtcgtgacctttgccgctcgcgagggatatgatccgcagttcggagcgcgtcctgtgaagcgagtcctgcagcgattcgtcctcaacgagctgagcaaggcactcttggccgatacggtggacagtacacgtcccgtcctcatcgattgcatagacggatcaatcgtcttccgcaacgaatagtagcctccggctgccttattcctcttattccttcaaggctccttcgggcaggtggcttgccacttcccggaggagccttttttatgtttcaaggggtatcttcgagtacatccctaaggggtctatatagagaggatagtatcctctcatatgagaccatagtatcctctcatatgagaccatagtatcctctcgtatgagaccatagtatcctctcatatgagaccatagtatcctctcgtatgagaccatagtatcctctcatgtgagaccatagtatcctctcgtatgagaccatagtatcctctcatatgagaccatagtatcctctcatatgagaccatagtatcctcttatataagactatactattctctccgtatttatcatgtttttttcaggaaatgaatttcactttatcgacagaggagaaagcaaagggatggcaatatcggtcggcttcgtctgtggttttcactttccatacagccgccatggagcaaatggagaggggcgaccggaaaaaggattgtttccccgaaagacgaacaagggctttcctctgcggagtttatcgggttaccttccggaagtagctgtagaagaggatgccgagcagtgtcaggctgatgggaaaggccgaccagataccggccaactgcatgggcgtattgcccgatatgaatacgaatcccagcaaataggagagtatcggtgccagcaatacgtggcagaaagctgctgccggagccagaaaacgaacgcgctccattcctcgcagagcattggaatagatggcttggagggcatctccgaattggtagacgacaacggggatcaacgtaagggcaacgatgtgcgccacctcttcgtcgggcgtgaagaggaaggaaaagctgtgccgtgtgagcaaaagcagtacaaccacaacgcaggcagtcaaagcggccattcggtaggcagtggcggctacgcggcggacttcgtcgggtttgccgtgcagcttgaagtgactgatgcggatggtggtggcagcaccaagcccgtaatagacgaggtagccgagcgtggtgatgacgcagacgatctggtgtgctgccagagcctgatcgccgagtcgcccgacaaaaaggacggcgatggtgaaagaggccgattcgagtcccatctggacggcaacggggagtccgacggagaataggcggcggtaggcgcgacggatatgcatctgccggcagaaggcgtggcggatcgctgtccatgagggtctgcgatagaggaaaaggacgatggtgacgagcatcagcaggcggctcaacagggtggcatagcccgcaccgaggagtcccatttcggggagaccgcctttgccgaatatcagcaggtagttcagcccgacattgaagagattgcccgatatggtaatatacatcggggtgcgcgtatcgctcatgccgtcatagaattgcttgaaggcattgaataccgtgacgaggaagaggcctcccacctgtacccaataataggggatggcgagagggcggagcgagggtgggaggttgaatgtatcgaacaggggaaccatcacggctgccacacctgcgaggaagagtccgatcgctatattgaggc

SEQ ID NO: 662 - DNA (genomic), 1783 bp, PORYPHYROMONAS GINGIVALIS; double-stranded, circular
  misc_feature 1...1783
  hypothetical: NO
  anti-sense: UNKNOWN
tcgttcccgtcaatacccgtggcagacagaagcgcgagagtatagatcggctgcaggaagctttggagagcgatttgcccgttatcactttcccggccggcttttgttcccgtctgatcgaaggtaaggtccaggataccccgtggaagaagagctttgtccgtcaggcctacgccagcaaacgggatatagttccactttttttcgatggacttaattcaaagcgtttctaccggatagagcgtctccgtcagctccttggtcttaagttcaatatcgggatggctttgctgccggatgaaatgtttcggagcaagggacgccattttcgcgtattcgcaggccggcctattccatggcaatctcttgcgtctgccccccgagatacggccgagcaggcacttcatatccgttcactggtatatgacctcagcccgtcggccttaaagaaataaccattaaacccatgtgcctcgaacccataattgctccgatttcatccgagttgctcgagcaggagctgactgccgatcgttttctgcggatgacaaacaaagccggcaatgagatctatgtttttacggccgaagaagctccgcattgcatgaaagaagtaggccgactgcgagaagaagcctttcggcattatggcggaggtactggcaaggcgatcgatatagacgagttcgacaccatgcccgggagctacaaacagctgatcgtatgggatccgcaaaacaaggctatactcggaggctaccgctttatctatgggcgggacgttgctttcgataccgatggcaagcctttgctggcaacggcagagatgtttcgcttcagtgatgcttttttgcacgattatctcccctacacagtcgaattgggacgttcgttcgtgtcgctccagtaccaatcgacacggatgggcacaaaggccatttttgtgctggacaatctttgggacggtatcggagcactcactgtagtcaatccagaggcactctatttctatggcaaggtgaccatgtacaaagactatgatcggcgagctcgcaatctgatcctgtattttcttcgcaagcacttctccgatccggaaggcttggtcaagcctattcatcccctaccgatagagatcagtgcggaggacgaagccttgttctcctcatccgactttgacaccaattacaagactctcaatatagaagtgcgcaagctgggtatcaatatccctcctctcgtgagtgcatatatagctttgtctccggagatgcgtgttttcggcactgcagtgaatgagtctttcggagaggtggaggaaaccggcatattcattgctgtgggtaagatcctggaagagaaaaaacaacggcacatagagagcttcatcctcagccggaacgaaaaaaaaggtctcgacagtagcaatggccgatcataacgaccgcggacgccaaggcgaagagatcgcgctgaaacacctcaggcagcaaggctatcagatagaagccctgaactggcagtcggggcggcgcgagctggatatcgtggcatccacgtccagagaactggtcgttgtggaagtcaagactcgtaccgaaggctttctactggcccccgaagaggctgtggacgcacgcaagcggcgactgatttccgaatctgcgcatcactatgtgcgtatgtacgccatcgatctgccggtacgcttcgatgttatatctgtagttttgagtgctgatggttcctgcaaacgcatcgaacacagagaaaatgccttccc

SEQ ID NO: 663 - DNA (genomic), 3834 bp, PORYPHYROMONAS GINGIVALIS; double-stranded, circular
  misc_feature 1...3834
  hypothetical: NO
  anti-sense: UNKNOWN
gggctgactccgatcggtatatctcctttgagtaggatccctttttcttcggcataggccgatacggcatgcagctgctcgtggagtaaaaattgtacgaagcgatagtaattggtctccgttttcagttcgggagataccgccattcgttcgatttggttttttccccacgtatattcaggccacagatggagtggcagtccctcgtacttgtcgcgcagatggcaaaaagccgcatatggatccaaccaatcggccgctgctgagacgaattgacggaaagctttcttgcgcatcacattcgccccttcctgtcgatacagggcatgcagaaattcctccttcagagccaacacagccggataatccatttgcttgagtgccctcagtgcttcggcctgcttctccatttttgccatcagagcactattcttcagtcgtggtagcgcatccaaatcggcatagataggatggatggcgatgaccgatactatattatatggataggagtcgcgataggagcgtgtgtaagtggtgtcgttgatgggcaggagctgtataatgcgctggccggtcattgccgcccagtccaccatacggcgnagtgcaccgaagtctcctatgccccaatccttgtgggtgcgcagtccgaatagggggatgacggtgccggcatagcgtggcatataatcaccctcgcggaaacagagaccggccaaatagacggcaccataggcatccgtctcttcgaatcggtaagatctgttttctccctcttcccaacggatgtcggagcagtcgtcttgtccggcaatgaaaaacttatattccaaaagtggaggtaattcatccttctctagcgtgatagaccattcgccctttcccaaatggtgcatggcacgggcttgctccactgaccagttgccaagagcaggactattgcccgtcatacagatcttctggtcggggtgaacacatggagcatatagctgcatgacgactttgacgccctctttcgttggtttcggggcacgtttcagcttctcctcatggcggaagaaaacatcgtaaaaagcagaactgaaaaagggtgcatttttcggtcgatcgatccagtaatcgtccatcagcactcgcttgtaaccatgatccaataccagatggtgcatgcgtttccactccttgcgaatggcgttgccttcggcgtctcttaccagatagtaatactgtatatccttgcggcgaccgtctatgatcacacgttccttcccatctgtcctcgcccgttgctgtcagctccaaggcaagtgcttcatcccaatttcccaattcggccgaagagcccgatatgcagaggcgttgcccccaatcggctcgatacttgatcgaaaaaactatctccatcgttcttacgaatatctcatctcattacagccgatcgatcagccactttatctcctcataggcgtaggcggcaaagctccccagccaatgatcgccaccataattgctattgaatatctgcttcatgccctcttcgtaatgccgcttggctgcttgtcgcatccgcattccgatgccatcattcgccggtaaagccctcgctatagctcccatacaccacgctctggaaaaggaaagtcctacgagatggactatgtgatagtcgttcagatcggatacgatgggaggtgtacacagacgttccaatccctcggtcgtaaaaaactgttcgaaccattgccggtaagtatcggcaggcatgattcgtctcatcagatcggcttcctgcagcgaaggagaaaagaagtccgtggcattaggttcccactcagccggtatggttcggtctttggcgaagaggtccaatgctttttggcggagtgaatcccgaaaacagctgtctcccatagcaacagcccagtcgtaggcaaaggccatggcgaaagccgagttggagtgcgtaccgatcctatcggcgtaggtcatcttggagagatgagcttttcaccgtgctacgatagtccgagagagaggggacatatgccgatgccattcttgccgcacggcttgccaagtgcgaagacacggcagcatcctgagatagccgaagcaattcctcatccaatttcaaaagccaagcccatccgtaggtacgctcgaacgtcgctcccccgggtctgtcgaaataggccgtttcggctgcgagcttctccgccgtaaacgaatgatcgagagcagcgacgatgctatccatcatggctaaatcgggtacgatgcgaagcgtatgtaccagcatccagtggctgtgtacgctgctgtgccaatcgaatgagccaaagaaaacggggtgcaactgagagggggtcagtcgggcatcggcttcgtcattgatcacctgtcctgtcttattagggtattctgtcgtaatactcttgaggggcatcctgacgaggcgcagcagcgtactcgaatcttgcgccgacaagagataaacagaaagtaaaagggaaatgatggtgacaattcttctcataattttcgagggataagcgtacaaatttaagactttggcctgatgaataccagtaaacgctttatttcctcgctgaaagctcgtagagtataataaaaagagtgtgccgaagtgctcacttcacactccggcacacccccccgtataccctttaggaaagggtgagaaatagcttagtaagtcagcttcatagagcgattacccactttgacgatgaacgttccgccctggcctaagttgacaacaatagacccgttgcccgagtaatcgctataaaccaaacgaccactgaaatcataaatacttacagcctcgccatgaacattgtcgatatggatattatctccgataacctgtaccatagccttggccatgcttaccgagggagtcagattcgtgggagaaggacagactccgaaagattggagcggactgaaaggagtcgttttgtaaccttgatattgtactccttggcctccatgcttcacggcagccacctgatggaacatttcattcttgaatactcgctcgggcacatttacatcgatcgattcgctttccaaatatctcttgaagaggaaaggatccggcaggctttcgccggccttatacttttgagtgatcttgagatcatcgacatagagattttccggtgcatatacggcatatatgccgattaccgaacgctccgttcccttggtcaaagaaacgttgaataccttccactgatcgaccagtccgtccgattcattcagatacagcagctctgactgcacatagtctccgacagtctcgtcgtattggaagagggcgatcgctgctcgcgtatagccttccacctgattgccctggccatcgtcgccgacgtatttcgtagcatagagcttcacactcaagtctatcttcccgccatctttggaaagatccaactccggtgagatcaggcctgcatcggtgtgattgaaaatgtactgccatgcatccaagcagatatagtccgtgtagggagcatagttagtccctttccagccggcttgtaccagatcgctcaggtaaacctcatcgtacgtataggtagacggattttctatcgtccagcctgtcagttctccggtaggagtctttattccatcgaagttttcgtcggtaacaaagaatgcgccgtcagcggcagctgtacgcttgaagcgagcgaaatagttgtagcgttcggctgaaggtacagcgttccatgaagcggtataggtcacatcttctgcggatgccgtgaggttattcaccggatttcatnttgggcg

SEQ ID NO: 664 - DNA (genomic), 1692 bp, PORYPHYROMONAS GINGIVALIS; double-stranded, circular
  misc_feature 1...1692
  hypothetical: NO
  anti-sense: UNKNOWN
tcgaactcgtgtcggatgagacgaccgtctcctcggcggatatcaaggcggtctttgaccgcgctgccaaagtgctcatccgtctgcttcaggacggcaagagcattgattgtggcgacatgggtacctaccgccccagcattacggcgaaggccggttcgggcgttgatagtgccgacaaggtgacggtggagcttgtggacaaggcgaaggtcatctatacgcctcgtatgaaggtcaaaactgctctcaagggcgtccgtatggagcgtgccgagcgtgtccttgatgtgccttacgcctcttcgatcaagccgaatgagaacaacagcggcggatcttcgtcctcggacaacaacggacacgccggcctgtaaacaaagcatttaatagcgacaacgataaatctgaacgtccttattcgacaatacatccctaaaggttcttctttcatcgatataacgaccaaacagatctccattatacacaacaaaccgaacctcagaccaggaaagaaactcggattcagaacgccgttcgaatgcttcttcccaaattcaccttagtgttgcatttatttgtggaatctgcacagccaacaaaaagaaagaaaaacgcaaccgaataagaataattgctatatttgcgtccgctatcgggatgtagcacagttggtagcgcgccacgttcgggacgtggaggtcggaagttcgagtcttctcatcccgacaacgccgtcaatattcctttgggattattgacggcgtttttttgtctgtaacaaatgcaaatcctcaccactccctaaacagagagaactgacggaggggtctgcaaaaagggcagataggttacatgtttttgccgaaaaagaactgcatcagcagcaaattcaagaccagcaaagcacctcccatcaagacgatctggcgctgttcaggcttgggaagcagaaaataggccactatgccggtgacgaagatgaccaatatcagaaaagtgatgatacgtgtaatacgtgatttgcggagcttcattatgtcattgtcaaaagagaaaaaaatcagagcgaaagagcgcggagtttgtagccacgagtgcgaagttcctgcaccagtcctttttcgccgatgaggtgaccggctcctacagctatgagagtgggctttgcagacagtagcgcaggtatcttttccatccatcgtgcattacgtctatagaccaaacgctccatatcctgaggtgtcatgtattgaccttcgaacacggcttctatctgctgagccttatagtccctgacaagtttggctaaaggattctgctccttttgtatatctcgaacagtcttaagcaggtctttagcttgctctttcaggcctttggaaaagaggagatattgcatagcatcccaagcctcatcctgcgtttcgaaaaacgcagcctcttttccgtcagcgagtccatgaacgacaacgccgacatccatcggttcttgcccctgaaggcgcatagtctcggcccccatactgacaaagaaagaaacgatagaggggcggaggggtatctggtcgacagaacccatgccggcggattggaggaattggttcaattcctccagctcttcaggagaatagagcatgncataagtggtatcgctcggtagcatcatgtttgcttgcaggcgcggcatca

SEQ ID NO: 665 - DNA (genomic), 826 bp, PORYPHYROMONAS GINGIVALIS; double-stranded, circular
  misc_feature 1...826
  hypothetical: NO
  anti-sense: UNKNOWN
ccctgccaaaagtaacaaaggaagcaatgaccatggacaaaagaactgtccgacagccagtattacagagcctaacgtaaagagggccggcagtatgtgtacgggcttcatactcccgggatgccgtctttgcaaatgaatacgggcaataccggagttgtacacctgacggaagaacttcttaaaatcgattcgccgtttatggaaaacaaaggcttccggaaacaagcatacgttgtatccggccttaaagagacgcagactaaaatcaatatcttcaccgaagcgcatctcttccgaaaaaccaccgagttgccgatagaccgaaagtttgcagccaaaattgaaactgcgaggatagaacttgtccagtcgtactcttctacccccacgaatgcctccggtcgtgaagaaagaggtcatcgcatagttaatggctttttgtatgggtgagaatccttctgctgctgcatcagggccgccgaaagcatctgcttgcatctgttcgatccttttttttactgcggctatataaccgctcggcagtactacatccgagtccaatatcaacagatattcgcccacagccattcgtgcaccaatgttgcgcgcagcagccggtcctccattcggcactcttacatactgtattcggagaagttctctgacgcgagtccacttctttgtcgcagcacacagacgaaccatcttctacgatgatcacttcaaagtcgctattcgtctgtataagcagactctccagcagctcccgcacttcgtcggggcgattataaacggggataataatagagaagaccgngggggg

SEQ ID NO: 666 - DNA (genomic), 1049 bp, PORYPHYROMONAS GINGIVALIS; double-stranded, circular
  misc_feature 1...1049
  hypothetical: NO
  anti-sense: UNKNOWN
ctgtctgatattgcccaagtagatggcttctggatggcgcaaagatgaatatgtccaatgtgcagacggggcatcggactgtactggaagattaagaaccggagtttaaccgtccgatcgacgaatcgaagttcactgttacttctctcgagaaaggttctctctaaactatggaagtgaagaaaaacacagtggtgctacgccttctgatttggttcgtggccattcttctcttccactcctcacggctgtggggacaggaaggggaggggagtgcccgatacagattcaaaggattcgtggatacctaccatgccgtacgcagctcttctccttttgatttcatgagctcgcgtacgagagtgagaggtgagctggagaggtcgttcggtaattcgaaagtagccgtatcggtcaatgccacctacaatgctctactgaaagacgagaccggcttacgtttacgtgaagccttcttcgagcatcaggaagagcattgggggttgcgcctcggacgacagattgtcatttggggggctgccgacggtgtgcgcatcacggatctgatctccccgatggatatgaccgagtttctggcacaggattacgatgatattcgtatgccggtcaatgcattgcgtttctctgtcttcaacgaatcgatgaaagtggaagtcgtggtactgcctgtattcgaggggtaccgtctgcctgtggatcctcgcaatccttggaatatcttctccctttcgcccattgctcaggggatgaatatcgtctggaaagaagaagccggcaaaccggccttcaaggttgccaatatcgagtacggtgcgcgatggagcactacgctctccggtatcgacttcgctttggctgcattgcatacatggaacaaagatgcccgtcatcgaagtacagggcattgtgccgacggaaatcatcgtagccctcgctattaatcgtatgggattggtcggcggcgacctcttccgtaccccgtcggacagttggttttcaagggagagcttgcgttcaatatcgaccaa

SEQ ID NO: 667 - DNA (genomic), 771 bp, PORYPHYROMONAS GINGIVALIS; double-stranded, circular
  misc_feature 1...771
  hypothetical: NO
  anti-sense: UNKNOWN
acgcctgaaatgaagcagctcatctcaggcatcaaagaagtaagcaaacgctttcgggagattgcccaaacacaccgtccgctctttgggggagaaatttaccttacgggacgaggaggtctgcgaacggcttttcgtcagtcctcgtaccttgcaggactatcggaacaagggcattatcccctacatccaaatcgcggggaaaatcctttatcgacactccgacatcaacctactactgcaagagaattatgtcaggcagagaactctatagcctgttcaaccatagctttggctcgctcaagtaaagctttggattctctgcggaaagcaaaactcttggacaccaaatccgagagtttttgctgtatataaacagggagcatagggattatcacttgggatatttccgagggcttccaatgctgaataatagaacctccagcatctcgctctgcttgcattcgcacaattggcgaattgaggacaagagtaagataatcgggtaaaagttcttttcccttcatactaagatgcaatattgctcctgaggtaataatgtcagcatcttcctccatcttataagcaatacctacactaccatcttttgagagaagaatggtatttttacgaggtcgtggagctgtggaataagtagagctatctaaacaaatacttgaagtctctataccaaatttacttaaggtcggctactcttacaaaaggtatccattttcttgataagcatcgcttacccggctctatgggatt

SEQ ID NO: 668 - DNA (genomic), 2800 bp, PORYPHYROMONAS GINGIVALIS; double-stranded, circular
  misc_feature 1...2800
  hypothetical: NO
  anti-sense: UNKNOWN
tcgacggcactgaaccagaacgtatcgctgaacgtatagaccaaggctccaacgactccactgccgagtatcgtgattactcgtggaaaggatattttccttgacggctcttccaatccggatacattgcgtactgtcggtacaagtacgcggcggacaaggtgggtaatcgtccaaaacaaaaacaggatggtaaaggcactggccagtgcactggtagcattggcaagccatgccacctgtgacggatcgctcgtgaaatgcgatatgatattatagacgagcatgaagaagggtgctccgggcggatgaccgatctccaacttgtttacgcagactatgaactcggcacagtcccacaggctggctgtaggctcgattgtcatcagatagacgatagctgcaactgcaaaaacgccccaaccgacgacattgttcagaaatctaaaacgtttccattccatatcattgtattcttctatgatgacttaaacgtattgagcaggggcaaaccctacttctcgcggataaaaatgttgatgggagtaccgcaaaaatcccagtgggcacgaatctgattctccaaaaaacgcttataaggctctttcacccactgaggcagattggcaaaaaaggcaaatgaaggcactgccgtcggaagctgcatcacatattttatcttgatgtatttacctttggtagcaggtggtggcgtagcctcgataatgggtagcatcacttcattcagcttgtgtgtgggaatacgagtcgagcggtgtgcatagacctgattgaccgtctccaacactttgaaaatcctttgtttggtcatagccgatatgaagagaagagggaaatccgtaaatggagcaaaacgctgccggatggcattctcaaacgtcttgatgacggcttgacttttatcttccaccaagtcccacttgttgatacatacaaccagtcccttgctattgcgctggataatctgaaagatattcagatcctgcgactccacacctcgtgtggcatccagcatcagcacacatacgtcggagttttcgatggcacgaatggatcgaataacggagtagtattccaagtcttcattcactttgccccttttgcgaataccggctgtgtcgacaaggtaaaaattgagtccgaacttattgtacttagtgtatatagagtcccttgtcgtgcctgcaatatccgtcacgatatgcctgtcctctccgatgaaggcattcagcaaggagcttttccctgcattggggcggcctacgatggctattcgagggagtgtttcgtccaaatccgattgtccgttctctgccggcaatagctccatcaccctgtcgagcaaatcgcctgttcccgaaccgctgacagctgcaatgcagtaaggatcgcccaagccaaaggaatagaattcggaagcggaataatgatcttcggtattgtccaccttattggctacgactataaccggttttttgcttcggcgcagtatctcggcgacttgttcgtcaagagaagtcactccggtctggttgtctgcgacgaagaggactacatctgcttcctcgacagcaatatacacttgcttattgatttcttcctcgaaaacatcttccgaattgaccacccaacctccggtatcgacgatggaaaactcccgaccgttccaatgcacccggccgtactgcctatcgcgcgtagtaccggcctcttcggctacgatggcttgccggctttgggtaaggcggttgaacaatgtgctcttgcccacattcggacggcctacgatggcgactaatgctcccatatctatttctactctatgatttcgttctgattgttgcttgtcaggctacgaccgacgaaggactaatccaactgatagccgaaggcacgaagcagattatccctgttgcgccagtctttttcgaccttcacaaagatttccaagaaaattttctttccgaagaaacgttccaaatcacgccgggccattgaccctacacgtttgatggccgcccctttagggccgatgattattcctttttgagaattacgctccacgatgatcagcgacttgatacggataatggtcttctcctccttgaattcctccacgaccacttctgccgcatagggaatttctttttgataatacagcagtatcttctcacgaatgatctccgtaacgaaaaaacgtgccggcttgtccgtgagtgcatctttttcaaagtaaggaggagatgggggaatgaggctttcgatacgcttctgcagcaatccgacgttaaagttgttcgtggccgaaagagggtgaatttctgctttgggcaatatattgcgccactcctccacaagttgttccaatgcttcctgattgctcaggtcgatcttgttgatgaccagaagtacagggcattccattcgtgatacgcgagcgagaaaatcagcattcttatcagccttctccaccacgtccgtcacataaaccagcacatcggcatccccgagagcagattcggagaactcccgcatttcctgttggagtttgtaattgggacgaagtactcccggtgtatcggaataaacgatttgcatctccggcgtattcacaatccccatgattctatgtctggtggtctgcgccttggaggtaatgatagaaatccgctcaccgacaagcagatttatcagtgtactcttcccaacgttggggtttccaacgatattgacaaatcccgaacggtgaccggactcctctacttgcatttcgaagctt

SEQ ID NO: 669 - DNA (genomic), 517 bp, PORYPHYROMONAS GINGIVALIS; double-stranded, circular
  misc_feature 1...517
  hypothetical: NO
  anti-sense: UNKNOWN
cgcacgttgtagtcggtcttcctataaccgaatgagagcgatgaccaatcgatattttccataatcctaattagaataagattgtttatgattaagatgataattgcaaatgtgtttcattcagcaactctgcaaaggtagcaaataatcaatctgttaattgcttttggttcgataaatgaaagcaggtacgcaaatgcctatttcggacgataccaatccactaacattcgtacacctgtggttatgtcgatccgatgcttccagcctaaggcatggagcttgcttacatccgtcagtttgcgcatcgtgccgtccggtttggaggagtcgaactcgataaggccctcgtaaccgatggtctttgctatcagcgaagccaaatcgcgaatggagatttcctccccggtgccaatgttgatatggcagttgcggatcttcttgagtcccgtggggatacatatcggcgaagtcgcaagtgctccatgaggaatacgcaggcattcggccatctctt

SEQ ID NO: 670 - DNA (genomic), 615 bp, PORYPHYROMONAS GINGIVALIS; double-stranded, circular
  misc_feature 1...615
  hypothetical: NO
  anti-sense: UNKNOWN
gttctcgcttcttcatgtctaaaaaaacacttcgttctcctccgacaataaagttttttccttgaaaagcctccgaaagagcagagaatccataaagtccatcatggaaatacatcgtgtattcctgacttttttcttgcattttttgtattgcaagttttcgaatttgttcattctcgatttgttttattttttcaggaatcttcatttcaaaagaataagaaaccgtcacagctttagactgcgagaaacttggcaaagcgctcatcattaaaaatattgcaaaaaataatctggccataacacaactttttactaatcaaagcgagagtattgcctcccgctttgattatattataggacaagttatccaaaagcctatagtcaaaaaacagacttagttcttttcgataataataataactactgtaccatcatcatagatgatgatccaaacctcaacctcttgtgcaactgagcttgagcctctgtgcaaagttttcaacagctacttcttgtggaagtgccaccgtttcagttgcacctgctgtcggggcaaagcacatagcagctaatgctacggctaacgatgcgaaaaacttcttcatagtcttt

SEQ ID NO: 671 - DNA (genomic), 875 bp, PORYPHYROMONAS GINGIVALIS; double-stranded, circular
  misc_feature 1...875
  hypothetical: NO
  anti-sense: UNKNOWN
ggactcaatgtcttccctttttcagcaggcaatagcgtctcgaattcttggaacggcatcaaccccgatcttctgatttatatgcntcacggacgtttgcggcaggccattccactgaaagcggaaggcatggcttgcgcaagcaaaatgtttcctattctggcacttctttacaatcggcaattcttcgagagacttggttggaagacaagcaaggtatggtaggcgggcttcctggcacaaagcgtatcgactcccgagttggacggagccatggttccctttgcattgattgctctcgaaaaagatgccaagacagggttacaactcttcagaaccatccccggacgactggaggtatttaccagtctggtgaacaaatacatcaccctaaagaacaaacctaacaaggagaagcgcgttgccatctactatttcaaaggaccgggacaaaacagcctcgtagcacaaggaatagagaccctgccttctatttataatgtattgcgcaagatgcagagcgaaggctatgatctcaccggattacccaccgatgaagcagctttcgaaaagatcatcatgacgcaaggagctattttcaatagctatgccgaaggcaatctggcacgctttaccgaaagcggctatcctgcattcgtacccacaagtgatttgaagcagtggatgcaagaagtccttacacccaatcaaattcaacatttgcaagaacgctatggagaagctcccggagaatactattcgatggagcaaaacggagtaggcggcatcggtgtaacccgtgtgcaagttcggcaatgtcgttcttttgcctcagcccgtacaaggtggaaggggccaacgactttcaaggccgt

SEQ ID NO: 672 - DNA (genomic), 10061 bp, PORYPHYROMONAS GINGIVALIS; double-stranded, circular
  misc_feature 1...10061
  hypothetical: NO
  anti-sense: UNKNOWN
agaaaccctaactttcctatttccgcttagatcgaactgacgttaagaaaagaccaatggtcatatcgcaaaaatgccgtacaatggtctctaataagcccctgggcgatgttgtacttcttctcgatggcatacttgctccgaggctgccgaggtattcttccacaatgtgaagacgcttggaatcagtcaaatgtttcgacatgattactgctttttttgacctctccgattccgtacacgtcgttcgtaaaaatggcggtttagcgtttggaaaaacgtggctcgggaattttttcgttttggttcgggaagtaaaaattttacgcgccacaacggaaaaattctcgctcgtgaatctcagaaaactcgaaccgcattccggccaattccggaaccaaattcgtgaggaatctgcttataggcatccttttctgcgcatcgtagtgaaagtaatcttggcgaaacgccttcgacctctcccgtaccttacttccaaatctaagtgattgtgtcttatgtggaattcatctcgtttccctctgtaatacagcattcgatgcgaggatacgataggatttttttatttttgagaccaacaaaaaagaataccccctcgactatagaaaacacaaggcgcggaaaggagagttgtccgatcttcacctttctgtatccgatagagggagattagagacctgactgtaaaaagtagatttatgaaagaaaaagagaaaatatacaggcatttgaccgaagaagaaatatccgtgctggaaggcaactactgccagtgcgccgattggacgatggtggaggtggccgatggctttgacgcgaatcgttgtctgcacgtcatgttcagcggacagatccggatcggatccacgcgaggaagtcacttgttgccgggaggcctccacgtgcctacgggtatcaatatcgcacgcctgcacaactgcattgtcggagatgaagtcgtcatcttccatgtcaatagctatttggctaattacagaataggcgattatacccgaatcgaaaacattgataccatagccgtaacggaatccacctccttcggcaacggcgtggaggttaccgtgctgaacgaaaccggcggacgtgaagttacgatcactgacaacctgactgcccagaccgcctatctgatggccatgtacaggcatgacaaggtgctgaccgaatcgcttgctgctatggcaagagcttatgccgagtcgcgccggtcggatatgggagcaataggctctcatgtggttatccacggatgcaatacgatagagaatgtttgtatcggagattataccgagatcaccggtgcctcgcatctctgcaacggcagtatcaatagcaagaaagaggcccccgtgtcggtaggctacaatgtcgtctgccgcgatttcattctctgttcgggcagcagcgttacggatggtgctaccgtttcgcactgttttgtagggcagggtactcatttggggcaccttttctctgcacatgattcgcttttctttgccaactgccaaggcgaaaacggcgaggcctgtgccgtctttgccgggccatataccgtgtcgatgcacaagtcgagcctgctcattgccggtctatactctttcctcaatgccggcagcggctctaaccagagcaatcacctctacaagctcggccccatccatcagggcatcgtggagcgcggctcgaagaccacgagcgactcttatatcctttggccatccagaatagggccttttcacgttggtgatgggtcgacacgtacaccatattgacagctcggccttccccttctcttatatcatagaggaccgtaacgaatcgtatttggtaccgggtatcaatctgcgcagtgtggggacgattcgtgacgccaagaagtggccggcgagagataagcgtaaagatccggatttgctggacaatatcaacttcaatctcttgagtcctttcactgccggcaagatgatgcgcggcagtcggaagctgaaaaagctacgcaagatactgggcagtgagggacaaacctatgtctatcatgatatgcgcatacgttcttctgccttggacaaggggctgatgttctatgagatggggctgaacaagtttttcggcaattccatcatcaaacgccttgaagattgtccttgccgtacggatgaggaggtgctgagtgctctcaagccgactcacaatgagggagacggcagctgggtggacatctgtggcatgatcgctccacaacaacagatccaccgccttgcctccttgatcaaagaaggcaagatcaaaagccttgcggaggtgaatgagcggatgaaggaaattcatagccgatactacgactatgaatggtgctgggcatacaacgctctgctcgaatggtacgaactgaaccccgaggatctcactcgatccaaagtagccgaactggtgcatacatggatgcgttcggtgattcgcttggatgagatgctctatgaggatgccaagaaggaattccaaatgcacagtcaggtaggcttcggaatagacctggtaggggagatgaaacaccgcgatttcgatgaggtgcgaggcgatttcgaaagcaatcccttcatcgtcgaggtggtggagcacatccggaaaaagcgtgctctcggcgaagagatgctctctcgtctggagtgaaaacagccattcgacagcgtctatcgacgaatggggtatggaaaatatgcttttctttgtaacaaactgatagaaaagaataatgactgcatataaacgagtgctgctcaaactgagcggtgagtcgctcatgggtgctcagcaatacggcatcgacccgaatcggttggccgattatgcttcggacatcaaggaggcttgtgccatgggcgtacagatcggcatcgtcatcggaggaggcaatatcttccgcggagtgagcggtgccgccaagggattcgaccgtgtcaaaggagatcagatgggtatgctggccacggtaatcaacagcttggctctcagctctgctcttgagggggtaggggtgaagaccaaagtgctcacggccgtacgtatggagccgataggggagttctacaacaaatggcatgccatagaattgctcgaacagggttatgtgaccattttctcttgcggtacaggcaatcctttcttcactacggataccggctcatcgcttcgcggcatcgagatagaagccgatgccatgctcaaggggacgcgcgtggatggtatctacacggcagatccggagaaggatccctcggctacgaagttcgaccggatcacatacgatgagatttatgcccgaggtctgaaagtaatggatctgactgccacggccatgtgtatggagaacaacctacccatcgtcgtcttcgatatggatacgccgggaaacctcctcaaggtgttgagaggagagaaaatcggtacttatgtttcaaatacgagtgcttgaaaggaatagcaagacaaaacaaacacatatagagatatggaaataaaagaactgatagccaaagcaacggctaatatggagaaggcagtggagtatctggacgagcagctgtctcatgtgcgtgcgggaaaggccagccccaaactcctcgatggtatcatggtcatgtactacggcaacgccactcctctgacacaggtagcatccatcaatacgcccgatgcgaagaccatcgttgtcaccccgtgggagcgttccctgatcaaggatatagaaaaggctatcatggactctccgctcggcattacgcccgagaacaacggtgagctgatccgtctgggccttcctcctctgacagaagaacgccgtcgccagttggtgaagcagaccaaaggagatgccgaggacgccaaggtgagtgtgcgcaatgcccgtcgcgatgccatcgatgcgatcaagaaaagcgtcaagaccgatggtactcctgaggacgtagccaaagatgcagaggcagagatgcagaaggttcacgatcgttatatcaagaagatcgacgaactctttgccgaaaaggaaaaggaaatcatgaccgtgtaagcgtgaaaaatctatccactcagcgatgaagcagagtttttcgattctgcctcatcgctgttttattacaccgcaaagccgtttatggatggagtcgtaattaagaatacgggtagtcagtatctggtgcgttgcacggatggtacggagctatactgcatggcgaaaggcaatctgcgtctgaaaggcatccgctccaccaatcccgtaaccgtaggcgatcgcgtggagattgtccccgcttctcaggacggacagccggcctacatcaaacgaatccatccccgacgcaattatatcatcaggcgagccagcaacctctcgaaagagtcccatatactgggagccaatttggatgctgccgtgctggtctgtaccatcaacgatccggtgactaccaccgtctttatcgatcgtttcctcgctacggcagaagcctatcgcgtaccggttattcttgtattcaacaaaatagactgctatacgcaagaagatcgcttgcaattggaccggctgtcggctgtctacaccgccataggttacccctgctgccacgtgtcggcgattacgggcgaaggcctcccggatctcaaatccctactcgatggcaagctgacactccttgccggccattcgggggttggcaaaagctctttgatcaatgccctgattcctcatgccgatttgcgcacaggggctatatcccaagcccatcataccggcatgcatacgaccacattttcccaaatgatcgacttccccgatctctcccccgggtcagctcttatcgatacgcccgggatcaaaggcttcggtacgctggaaatgggcgagtatgaagtctctcattatttcccggagatattcgctgcaagtaaaggctgtcgattcggcaactgcacgcatacgcacgagccgggctgtgccgttctggaagctcttcggaggggggagatagccgagagccgctatatcagctacttgagcattctcgaagatgaaaatgccgagcggtatcgtcccgaatactgaaggacgaacgttttcttatctttgtcccataaaattgggagaaggggtgcttcctgtagcaatcggaatgcgtggatggctgagaacaaaccctcatcacctgaaccggataataccggcgtaggaaactctccgtctgactatcttcacggcgaagcaatcattccccctctctcttctttgtccaacttcaatgataagagatttatgaaaaaacttcacatgattgccgccttagccgtcctgcctttctgcctgacggcacaagcacccgtctccaacagcgagatagatagtcttagcaatgtgcagctccagaccgtacaggtcgtagctactcgcgccacggcgaaaacccctgtcgcttacaccaacgttcgcaaggccgaactttccaagtccaattatggtcgtgacatcccctatctgctgatgctgactccctccgtggtagccaccagcgatgccggtacgggtatcggatattccggctttcgcgtgcgtggcaccgatgccaatcgcatcaacataactaccaatggagtacccctcaacgactccgaatctcagtccgtcttttgggtgaatatgcccgacttcgcctcttccatcgaagaccttcaggtgcagcgaggtgtgggtacttccaccaatggtgccggagcttttggggcaagtgtcaatatgcgtacggataatttgggactggctccttatggccgtgtcgatttgagcggaggttcgttcggcacattccgccgatcggtcaaactcggtagcggacgcatcggtcgccattgggcagtggatgcccgcctgtccaaaatcggttcggacggctacgtggatagaggaagcgtggatctgaaatcctatttcgcacaggtgggctatttcggtagcaacacggctctcaggttcatcactttcggaggaaaagaagttacgggtatcgcatggaacggtctttccaaggaggatgaagccaaatatggccgccgatacaacagtgccggtcttatgtacgtggacgcgcaaggagtaccgcactactaccacaataccgacaattacgagcagcgtcactaccatgccatcatgacgcacagcttctctccttccgttatcctcaacctcacggcacactacacggccggatatggctatacggacgaatatcgtaccggacgtaactaaaggaatatgcactgcagccctatgtggaaaacagtgtgaccgtgaagaaaacggatctcatccgtcagaagtatctggacaatgacttcggaggactcatcggttcgcttaactggcacaccggtgcatgggatttgcagttcggggcctcgggcaatatctataaaggagaccacttcggccgtatcacttacatcaaaaagtacaatcagcccttagctcccgacttcgaatattatcggaacagggcagacaaaagagaaggtgcagcctttgccaaagccaactggcagatcactccggaactgaacatgtatgccgacctccagtatcgtaccatcggctacacgataaacggcatcacggacgaatatgatgaggtacagggaagtatgcagcacatcgatttggacaagaccttccgcttcctcaatccgaaggccggtcttacctatagtttcgacgatgctcatactgcctatgcttctgttgcggtagcacaccgcgagcctaacagaaccaattacaccgaagccggaataggacagtatcctacgcctgagcgactgatcgactatgagctgggctaccgctatgcttcgcccctcttgtcggccggagtaggtctctattatatgcaatacaaggaccaactcgtgctggatggccgtttgagcgatgtgggacagatgctcacaagcaacgtccccgacagctaccgtatgggactggagctgactctcggttggcagatccttcctcgtttgctgcgttgggatgcttctttcactatgagtcgcaacaaaatcgaccgctacgtacaatatacatccgtatatgatgcggactacaactggctcgaactcaaggaggagaccctcgaaagcacggatatagcctactcgcccaatgtcattgccggcagcatgcttaccctctctcatgccggtttcgaaatggcttggacgagccgcttcgtcagcaagcaatatctggacaatacacagcgcagcgatcgcatgctttcctcctattgggtgaacgacctccgcctcggctatgtgctgccggttcacttcgttaagagagtggcactgggcgtacagctcaataatctcttcaacctcatgtatgcgtccaatgcctacatctacgatgccggttacgtacaggcatccggagaactaagtgcatatgccgatctgcgttattatcctcaggccggatttaatgcactgggtagtctgacaatcgatttctaatccgatgatgacagcggtgatccaattcattgtggctcatcccatcgagctggcagcagcactcgtcaattttatttgggtctatctcgaatataaggcgagtgtctggctgtggcctgtggggatcgtcctgccgctcttctacatttatctctcgatcgaggcgcagttctacggcaatgtgctcatcaatgtctactatctgatcaccagtattatcggctgggtgatgtggcttcgccaccgcgaagggacggaagagggtgccatcgtatccatctccccgcgtgtcctgtggatcagccttgctgcggctacggtggcttttctcccgatgttctatgtgttgtcccactatacggatagtcttgtgccgtgggccgatacgcttgccactgtaatcagctttgtcgggatgatttggttggcgcgtcgcatccgccagcactgggtgtgctggttcgtagccaatatcatcagcttatcccttttctataaatccggcgaccatatcaccactgtcgtctttgccgtcaataccgttatgtccgttctgggatatttccggtggcgcaagatgcaacgacaggccacaatcagcatcgacctatgattttctttccctcgcttactccggagacagctccgctttttgttattctggctaagggggaatttccccgtaaaatcctcccccttgctatcctccggcgagcatcggagcatcctgaaggtaccatcgtctgttgcgatggagccatacagaatttgctggactatggtgcagagccggatgcagtagtgggcgacttggattcttttacagcctcgcgacatattttgcctgcagaaaaactacatcgcatagacgagcaggataccaatgatctgacgaagacagttacattctctgccgagacctattcccctcgcgaggtctgtctgctggggacatcggggcgtcgtgaagatcattttgtcggcaatctggcacatctgcccggatatacccgctttttcgaaaagatcgtgatgcctacggattacggatgttttttggcttttaacggggaggctcgcatagaagtggaagcgagggagacaaatttctatattcagtttcagcggatcagccgtcacggccgaagggctgaaatggccgcttcgcaataccactctgccggagttgtggtgcggaacgctcaacgaggcagtgagcgatacgatctatctatcctctgctgccccgttggtcgtctttgtagctgatgaagtgaaaaaccggtagaataaacttcctctctgcatcccctaagaaaggaacaagcagcttctgtctgccaagctttagtaaagcaagaaagcgaagtcaatggcagagcctttgtcttgcgataaaaggaggcaggctgtgattacgacagaccgaactcggccctgatcttatctacgtaatccaacttttcccatgtgaatagctccacgattcgcatctgttccgttccgtgctcatcgacaaaggttttgtatgcttcgtagggttcgcgcccgaagtggccgtatgctgcggtctcttcgtatatcggattgcggagtttcagtcgttgctcgatggcgtaaggacgcatatcgaaaatcttcttgatcttctccgctatttggccatccgatagagccacatgactccggcctttcgtattgacgtatatgcttaccggctctgctacaccgatggcataggctacctgtacaagcatttcgtcggccacgcccgctgccaccatgtttttggctatgtgtcgggcggcataagccgcggagcgatctaccttggacgggtccttgccggaaaatgctcctccgccatgagaagccctgcctccataagtatccacgatgatctttcgtcccgtcaggcccgtgtctccatgtggccctcctatcacaaacttacccgtaggattgacgaataggcgtaccttttcgtcgaatagggctgcgatctccggtttgtacagcattttcactcgggggatcagtatggtagctatgtcatgatggatgcgctcctgcatcatccggtcggcttctgcttctgaaataccgtccgatgcttggacaaattcgtcatgctgggtggaaatcacgatcgtgtctatccggacgggtctgccttcatcgtcatgttcgatcgtcacttggctcttggcatcagggcgcaaataaggcatcggagaagaaggctccttgcggatagcggccaattcgtagaggaggtggtgtgccagatccactgtcaggggcatgtagttctccgtctcgttcgtggcgtagccgaacatcataccttggtctccggctccctgctcggatcgatccgatcggtcgactccgcggttgatgtccgcactctgctcgtgaatgctggagaagatcccacagctgcgagtatcgaagcc

SEQ ID NO: 673 - DNA (genomic), 525 bp, PORYPHYROMONAS GINGIVALIS; double-stranded, circular
  misc_feature 1...525
  hypothetical: NO
  anti-sense: UNKNOWN
ggaaattccctaatgattccaaatacaacgcaatcctacagattggaggtggctggcctgaggaagcactttgcgagctgagtggagatagctggtttacctcctcgggaaaactcatgctttcttctttcacagatctgtcattgctgaattttatgaaaagcatgtgctatagttggaagacgataaaaccgatggtgattgnaaccccatgctgggagcctctacctcctatgatgcccggaattgcagcataccatgcctatacagttttgggatatacagtttccaatggagcctattacctgattatccgcaatccatggggagtgactgagccaacaggagatggagtgctaagcacaagagattgggttatccacttcgataatatgaagtggttcaatctatccaaagacgatggcattttcgcactccgacttgataaagtgagagagaacttctggtacatcgcatatatgtattgatatcagattatattatacggtttgagaacgatggagg

SEQ ID NO: 674 - DNA (genomic), 2251 bp, PORYPHYROMONAS GINGIVALIS; double-stranded, circular
  misc_feature 1...2251
  hypothetical: NO
  anti-sense: UNKNOWN
ggcgatttcttcttgcacttcgggacgaatgagaggaatgggaattttctcaaactcctgcttaccaatacctgtaaggattgttcccgaacaagcttttttgagtagttgctgtataggtagggacttgaaaagcgttagcaatgtctctggattgatttgatttgagcgcacaacatagaagccagtcgagcagagcgattggtcataatcgtccgttatcaatgcacaactactcaaagacccctctatagatgaaacaatcacatcgccttgggttacgatacgccttgcacgtgtgggcaggtcttcaccattttcgtacaaacagcctgtaatgtcgcccgacttgccaatattagccaactcaatgtagcgatacttcatatcacattctggcgtatagttgctgtctttaatggtgcagacctcaccaagaggagcgacaccgccagtgtatgccgatactgcattgatgtaatcctcatacttaggcaaataatactctgcatcaatgcgtccactttcaaggaagctctctttgagtgtctttacgttgtaagcatctatattggctacaaagtcttgcatccctaagcacgccaatagatagctctcagcagaggagtagagggatattccctctgtcgacttttgcatggataattcaaacagctctttaacctgcatttgtatctcagcacttaaaacaggtacaagtaactcattcctgcattcgtccaaattgagatgcatttggacattgccagagaatcgctttttcatttgctccattccatattttgtattcaagaacgttacaagatagggggagtttaatttgctatttagagctaacttaacagcaacagtatcttgagatgtgttacattcatcaatactcactatagatgctgcaggtattgctgttttcgagagtattatatcatttctaacgagagctgttttatgattatcgtcatgtattgctctagggatacagacaatgtctgtggtattaattttcatccccttcaagttagagatacgaacaaaggggactccgctgtcggaaaaattacctgcattcacattgaaaataccttttcttaccactttgcattctttctgcagggttgtgtattgcaaagcctcaatcttacgtctataactcaggtatgtacggtcatatagttctgcatctattctgaaatattctagcttagacaaccttacctccgtagcttccagcccctctaacaaagcgttgtactttacttcgtcaaaggggcgtccgcgaaaaaagagagtctctctttcttagcgaactctgcaaaggcttcagctatgccatcttcggtcagtccatcgtggttgaaaagatcgtgcttaacgataagatgcccgtgggtgtcaagcaaaggaacattctcgccctcctcgttagtggtgctgcgataaatcttgtcgccactattgtccttgcttggctcttgcatggtagcaaagaagatgttgtaatcctctactcgtgggcatagctcctcgtcccacttttgcacaaagagtacgctcgtcttagtacctgtatgaggcttaaatacattgccatgcaagcctaccactgcaaggatgcgacagcgatcggcaatgtattcgcgcaaagctttgtcgctgctgttgttaaaacgcccttgaggtaatacgatagccatacgaccgcccggcttgagaaaatcaagattacgctctacaaagaggatgtctcggctcatattcccagcttgcttgagcttggtctttcgatatgtaccatcactcatctgatagatggtttctcctgtattagcgagagcttcagaaaaggtcggctcgccctccacgatggttgctcccttaggggctattttcaccttttcgagagacatactacggctcatatcgtacttggcaagtatacgactctccttgacctctcccgcaaagggtgggttagccatcacaatatcgaaggtgaagtcacgataactgtccttgcgtgttctaagctttttgagtttcttccaaccctcgaaataagtgtcctgccaatcctcactatctaagttttgttcccatcgttcatagtcgagcgtattgaggtgtagcacattggtctgtccatcaccagcaatgagattgagcgtgcgagccacacgtaccgccttctcgtcaaaatcaatggcaaacacattgncattcacataatcgg

SEQ ID NO: 675 - DNA (genomic), 476 bp, PORYPHYROMONAS GINGIVALIS; double-stranded, circular
  misc_feature 1...476
  hypothetical: NO
  anti-sense: UNKNOWN
ggtataaacaaccttaccgttcatgtcgaacagagatacctgacgaccattagctccggctacatagataacgccattctgaacataagcattagccttgtcgttggtaagaacagcctcaacaccttcacccttcttcaaatgaacaacgacatagatgttgtaatttaaggtaggaactgcttgatgaagagattcgaacggagggaaagtagcaccaccatcttctgatatagaaaccaaatctccataaccatcaacggcagggccctgatcncatccgataggatgtccacctgcggtattagcaatataaccaactatgtaattcttgccggcttcaatcttgacactagtcttgagagcaagattgttgatagtctgcatttcgggatcactatcttctgattgggccaaaatggtcatatcatcagcccagactgcagatgtgtacttgcacgctttatatccaggga

SEQ ID NO: 676 - DNA (genomic), 800 bp, PORYPHYROMONAS GINGIVALIS; double-stranded, circular
  misc_feature 1...800
  hypothetical: NO
  anti-sense: UNKNOWN
gcgtacgaccctttcgatggggcataaacaacgaaagaaaacgagacaacaacaaaaaacgaatatagaattatgggaaaaatcattggaattgacttaggcacaacgaactcttgtgtctctgtattggaaggtaacgaacctatcgttattacaaacagtgagggcaagcgcacaacgccctcggtagtggcttttgtggatggtggcgagcgtaaggtgggcgatccggccaagcgtcaggccatcaccaatccgaccaagacgatatactctatcaaacgcttcatgggcgaaacttacgatcaggtttccagagaagtggagagagtgccattcaaggtagtacgtggggacaataatactccgcgcgtagatatagacggtcgtctctatacgccgcaggaaatttcggccatgatccttcagaagatgaagaagacggccgaagactacctcggtcaggaagtaacggaggccgtgatcactgtgcccgcatacttcaacgacgctcaacgtcaggcaacgaaagaagcaggagagatcgccggcctgaaagttcgccgtattgtgaacgagcctacggcagcttctctggcctacggtctggacaagtccaataaggatatgaagatcgctgtcttcgacttgggtggcggtaccttcgatatctctatcttggaattgggcgacggcgttttcgaagtgaaatcgaccaacggtgatacgcacctcggaggagacgacttcgaccacgtgatcattgctggctggcagaagagtcaagtctcaagaaggtg

SEQ ID NO: 677 - DNA (genomic), 728 bp, PORYPHYROMONAS GINGIVALIS; double-stranded, circular
  misc_feature 1...728
  hypothetical: NO
  anti-sense: UNKNOWN
cagatcacgaagaccagcgggcactcccttttgggcataggcgatttatcatcgccaagcatcgtaatggtcctgtggatgatgtacgtttgcgctccgcagcgagttgccaagttcctacctcttgaggccgagagcatggtcaaacgccattcccgtatcggaggctcacccgtgaaaatgggtgtcggcaacggatcgttcgcccctcccctacctccaccgaggacaatcccctcctttcaggcccctattcttccggcacatccgaggccgatttcctcgccgaagcatcgggaatcgacaaccctttctgatattatcaggaaacgatattgcatatttatgagccaatatacatggctcaggctcaattagagcctaatatattagccatcccttaaaaagcccttatgggacaactagatagggttcggagcaaagacgaaaccacggtatatagacagatcgaactgaggctaaacacgtgccaaaaaagttttcaacaacgaagaggagtttggaatgattccaaataagcaagtgaaaggaagtggacattgaagtcgaaaagttgaggatacggactttttcaagtcgaaatatgatttttggaagagaagataacgatctatatacaaacagtttacgataaatatatagatcgttttcgttttgtatataaatcgttttcaatttatatatagatcgaaagtcatttctagaga

SEQ ID NO: 678 - DNA (genomic), 917 bp, PORYPHYROMONAS GINGIVALIS; double-stranded, circular
  misc_feature 1...917
  hypothetical: NO
  anti-sense: UNKNOWN
ccagaggaaagcaaggttaaagatgagcgcaaaagcttatgccaatatccatcaaaggtgacaaagataccaagatgcatatcttcgaacaggtaaaatatgagcttcgtcgtgctgatgctttgaatatcaactattcggctcgtaaggacaccaaatagtatccttgtagaagaataaatacccttataaaaggctgtgtatgaggaaactcacgacacagcctttttcattacttcactgtcataaggtttccttagcagttgtaagaatgttttttcagcctctgactaatagaaaaatacacggaaatgggttttttgtgcaaaaatcagcccgaaaatttgttgtgtaacgtaaaagcggataactttggcacagaaaaaggtttatgacagatatccatccgcccctccttctcatagatacctctactcgcgtttgctcagtggcggttgctgctgcaggtactattatctcacaacgggttagccatgtgggcaattcgcatgctgctaacatcggcgtattcgtacaagaggtcttgacagaggcaataggcttaggagtgaagccttccatagtagctctaagttccggtcccggatcatataccggactacgcatcggatcgtccattgccaaagggatatgctttggactcggaataccgcttgtgtctgtccctactttggagttgattgctgaggctgcacgaccactgtctcaacctgattggttgatttgccctatgatcgacgccagacgtatggaagtttatacagcacttttcgattccaaaggtaaagcccttactgatacactgcctttggtgatagacaatgattctttttccgaagaactcaaaagcgcaatatcttattcgttggtgatggtgctgaaaagtgtcgcccctt

SEQ ID NO: 679 - DNA (genomic), 1167 bp, PORYPHYROMONAS GINGIVALIS; double-stranded, circular
  misc_feature 1...1167
  hypothetical: NO
  anti-sense: UNKNOWN
cgcacggcaatctgtttccggcacgaagcaaagatgctccctccgataaatatcagagagagcattttcggaacgacgtttctgctcataacaaccggctcatgcatagtccaacgatgccaaaagctgcgccagccgatccacaccttcgtgcagaggcttgtccagcataggcttcacaaacatattcagctcggcacgcagggtaatcttcagtctggtatcatcgggtgcagcctctttgagctggatccacacgttgaaaggcatgggagagcgttctgcctcgaatttgatcaggtcgtcctgacgacgctctactattcgcaaagtaatctgccccaccggattcactgatagcgtacagctatcactgtctatccccgtcagcttaatctttccctcgggcagtttatcctccatccccttgagattggagaggtccgacagtttggaatagacagccgagagaggtgctgctatactttttatttcacttgtgtattctgtcatactttagggtctatatagtttgtgtacgaagtgcgtagtccgaggagaaatcagataccccacgtctcgggactcttgcgccattcgcgaagcagctccacattctcggcagaaatatagcccgtccgcaaggcttcttctatcacctgatcgtagtcggtaagcgttacaagcttgacttctgctttctcgaaattctgctcggccatcgggaatccatgcgtatagactgcgaccatacccaatacttcgcaaccgaaattgcgtatggcttctgctgccttgaggctgctaccccccgtagagatcaagtcctcgatgactaccaccttgctgttcggcttgagttcgccctccacaaggttctccaatccgtgatccttgggagacgagcgtacatacacaaaaggcaatccgagcagatcagccaccaatgctccttgagctatagcccctgtagctacgcctgcaatagcctcgacatcaccgaaagtttcggaaatcacgcgagccaattccaatttgataagagagcggatttggggataagacaacgtttttctgttgtcacaatagataggagctttccaacccgaagcccatgtgaaggggttgttcggctgcagtttgatggctttcacctcgatgagcttc

SEQ ID NO: 680 - DNA (genomic), 608 bp, PORYPHYROMONAS GINGIVALIS; double-stranded, circular
  misc_feature 1...608
  hypothetical: NO
  anti-sense: UNKNOWN
gggactgatcaacgacgatgatatcctccggagcaaagttgtctactagggttacagactgggttgtgatgatcacctgcgactgcagagaaacactcttgataagagctgcgagtttattgatcgccatagggtgtaggccaagctcaggctcatcaataataatgctccgaggtggctcaggctgaagcaaaagcgtagcaagacagatgaagcgaagcgtgccgtccgatagctgataggcgttgaaatagacatcctccgnccctttttgcttccattctagctggatcgtactctcattaagacgattgggcataaggttaaaaccctcaaagaatggagcaacagagcaaaccgtacgctctatgcgatagaagtgcttcgggtgcttttgttggaggtaatacaagaaagctgcgatattggcaccgtcacgcctaaggctatgattgtcatctacacgacatagtgctttcataggggattgattcctgtgtcatggaagtggtagatcttcaatgcttggatcagttcattaacaaaatatgcctgtccccaattgtaatgttaaaggagactcatctacatcgcgctcatattcacgt

SEQ ID NO: 681 - DNA (genomic), 543 bp, PORYPHYROMONAS GINGIVALIS; double-stranded, circular
  misc_feature 1...543
  hypothetical: NO
  anti-sense: UNKNOWN
gggacggtacaggcataatatcttcttcgtttagatgagaggagagtacaacctccaaatcgccttcgggttgtcctccctccacatcgtgaaaaaccaaagagaggtcaatccatggatctcccgatactatccactcgcctaaaagcgacgatacgacttcatacaaagcatcggctttttcatttgtgtaaagcaaagccgggtaggcccctgccatacctgacgcattgaagagtttcgtccacggaaagtatgtgacaagatggcctatggaaaggttttcagcatggacattatgctctccgaaaacgataagctcattgtcttgcgtatcaagtcatcattcagcttggcattaggcgatatgtacaagcagtctacagcaaatacagcggagacaggctccgcaaagcgagtctttcggttcgccggactaagagcaaaagaataagataagcaattgtgcagtcagcaccctcaagaacatggtcagaggatagaccgtggcgtagcctacggccggagcatcgnggttagtcg

SEQ ID NO: 682 - DNA (genomic), 583 bp, PORYPHYROMONAS GINGIVALIS; double-stranded, circular
  misc_feature 1...583
  hypothetical: NO
  anti-sense: UNKNOWN
ttcccttcgttgagtaatagcggtatgttgtgccgtgctgcaacagccgtttcatcatttcgctcgatatatatgccttgggatgctttggacatcaaggctatgaagtcgatgccgagtccgccggtcagatccaccactttggtcccttctcttatgaaacggcttttgtacgaactcgtgacagctccggaggattgctccaaagaaagccgtgaaggaatatacaaagaactgataccggcccactgaggcagcttgttcctcagacgaggccaaagttctatctgggtagccactgcagcccgatactccggaggaatatcattgctccccaacagaattctgtcgggtgattggttggcatagagcttaacccatcgcgtaatggcgagaatctctttttcggcgaatagcatcgtccgtacgtatactgaaagagggaacccttcgaatggattccctcagagactgtgtgaccgcgacaggattcaaacctgtaaccggctgatccgtagtcagctactctattcagtgagctacgcggcatcgcaaaagctgaacattgaggagaaaaagtgac

SEQ ID NO: 683 - DNA (genomic), 2902 bp, PORYPHYROMONAS GINGIVALIS; double-stranded, circular
  misc_feature 1...2902
  hypothetical: NO
  anti-sense: UNKNOWN
tgggtacgggcaagaccactttcatcaaagccgtatgcgaggagctgggtgtctcggacgttatcaatagtcccaccttttcgattatcaacgagtaccgctcggatcagacgggcgaactgatctatcacttcgactgctaccggctcaacaagatagaagacgccctgaatctgggtgtagaagactatttcgatagcggtagtctctgctttatcgaatggccggagcttctggagccgatactcccgaacgatacggttcatgtccgaatcgaagagctggaagacggcaagcgcaggcttacattctaatgcctgctccgatgtcgttcgtcattcgggacttctatctcatcctctttgccatagtcggtctggtttcgctactgactgctctgctctgtccggattggctactgagcagccgaggcgcacgcatttggatcaatgccttcggcaagcgaggcgcacgtatcttctatattataataggagtggccttgctgagtgctgcggctttcgggctgatcaaactctgaaaagtgtcttgcagtaaaatcgtcatcataaaagagaccgcccctgctcagcctcattttcgtatattccttataacctcttcaaggggaaacctctacctttacggtcggaatcaatttcagaccgatggattacgaaatagagaacaaccatgccgacagtattcgcaggggaagtatcgaagtgatatgcggctccatgttcagtggcaagacggaagagctgctacgccgtctgcggagagctaagatagcgcgccagacggtggagatattcaagccgaccatcgatatacgctacgacgaaacggatgtcgtttcgcatgacaagaatgctatcgcttccacccccgtggacaattcggccaatatactgctgctatcctcccaagtggatgtggtggggatagacgaagcccagttctttgatgagggtcttgtggaagtagcccagcaattggccgatcagggtgttcgcgttgtgatcgccggattggacatggactttcgacgtcagcctttcggacctatgccgggcttgtgtgccatagccgactccgtgaccaaagttcatgccgtgtgtgtggaatgcggccgattggccagctattctttccgtcgtgtccaaggcgatcagcaagtgatgctgggcgaactgaacgaatacagtcccctctgcagaacctgctacaggaaatgcagttctcccccacaaacagaagaaatccattcgacaatatgaatagcagacatctgacaatcacaatcattgccggcctctccctctttgtactgacattgggcggctgctccgtagcccaacaagatacgcagtggactctcggcggaaagctctttacttcggcgtggatacaacgttcggccgaatatcaagcgctttgcattcaggcatacaacatcgctacggaaagagtggacgctctaccggcagaacgtaaacaaggagataggccttatgccatcgtaacggacatagacgaaaccattttggacaatacgcctaactccgtgtatcaggctctcaggggcaaggattatgatgaagagacttgggggaaatggtgtgcacaggccgatgccgacacactggcaggagctttgtctttcttcctccatgcagcgaacaaggggatcgaggtcttttacgtcaccaaccgcagagacaatctgcgcgaagcaactcttcagaaccttcagcgttacggattcccctttgccgatgaagaacatttgcttacgacccatgggccatccgacaaagaaccccgtcggctcaaaatacaagaacagtatgaaatagtattgctcataggagacaacttgggcgacttccaccacttcttcaatacgaaagaagagtccggacgcaaacaggctctgggcctgacagccggggagtttggccggcacttcatcatgctgcccaatcccaactacggatcttgggaaccggcatggtacggcgggaagtatccgccactgcccgaaagagacaaagcacttaaacaactgcactcacagaacagcagatagctccttaagcaaacacatcgaatagacagactcacactatggacaacaaacgactaagcaaaatagaaagactgctccagaaagaactcagcgagatattcctgcgggatgcgaaatccctgccgggcgtaatagtttcggtaacgaacgtacgtgtaagtcccgacctcagcatcgcacgtatacacctgagtatattcccatccgagaagagcagcgagattcttgagagcatcaaacacaatacaaagacgatccgttatgacctcgggcagcaagttcgtacccaactgcgcaagataccggatttgacattctacatagatgactctctggattatctggagaatatagaccgtttgctcaatcaataagaaacggtcgctctctatcaagacgctgtgaacttcccttttttcatagcccgccgttacttgttctcccgcaaaagattcagtgcggtcaatgtggtttcgctcgtttcagcgatagctgtctgcgtggtctcttcggccttggtttgtatcctctctattttcaatgggtacgaagctttgatcatgacgcattcggcagtaacggatccccctcttatgattcgttcggcagacaattcgctgataaaggcagatgataaaactctgctcacagctctcgaagcggaagggatcggttcgtacagctttatcctcaccggagaaggtcttgtaaagacgaagtatcgacagcaggctgtttctctcatgggtgtggatgatcgctatccccgcactgtgaagatagactccatcgtctttgcaggcacat

SEQ ID NO: 684 - DNA (genomic), 803 bp, PORYPHYROMONAS GINGIVALIS; double-stranded, circular
  misc_feature 1...803
  hypothetical: NO
  anti-sense: UNKNOWN
gcttcttgaatgcctccaaagcctccggcttgtcactgtctatccagcaggctttgtacaggctgatcggttcccaacgacactgcgctccgtattcatgcagcagacggtattggatcacttcgaactgtagctgccccacggtcccgataatcttgcgcccgttgaactgattggtgaatagctgtgccaccccttcgcccatgagctggtcgatccctttggccagttgcttggctttcatcggatcctgattttcaatgtacttgaatagctccggcgagaagcttggcaaaccgcggaaatgaagctcttcgccggctgtcagcgtatctccaatctgaaaattgccggtatcgggcagaccgataatatcaccggcataggcttcatccaccgtctccttgcgctgcgccataaaagccgtaggactgctgaatcggaactgtttgccgaggcggatatgcttgtagttcgtatttcgttcgaaccgaccggaacaaatcttgacgaaagcaatacagctgcgatggttgggatccatgttggcatgtatcttgaaaacaaaacccgtaaattcctcctcgtgcggatccactttcctctccactgcagccaccggctggggagaaggggcaatctcgacgaagcagttcagcagctcctgcacaccgaagttgttgagtgccgaaccgaaaaacaccggagcaagctgtccggccagatattcctctttgtcgaaaggctgataaacaccatcgatcaattcgatgtccgnacgcaacttctcagcttgagtgtct

SEQ ID NO: 685 - DNA (genomic), 1443 bp, PORYPHYROMONAS GINGIVALIS; double-stranded, circular
  misc_feature 1...1443
  hypothetical: NO
  anti-sense: UNKNOWN
gaataatgttattaaaggttgataattcagtatcaactgaccggatgattatcgatagatataattgaataatagaaaatctgaaagaaaaatccgcttcatatcgacacaacaatggaggagaatctttttatgtaagccatgctttggcctaatagcatgagtatgaggtggaagtggcaaaaaaaacaaaatcggccaaagagagggaaacagctctctttggccgattttgtcttttcggtaataaaacaaagtctttttatagaccgtgctcgcccaaataacgctctgcttcgatagcagccttgcaacctgatccggcagccgtgatagcctgacgatagtgtgggtcggcaacgtcgccggcagcaaatacgccgggaacttttgtgcgcggggacgaaccttccgtcaggatataacccacttcgtccaagtcgaggtagtcggcgaagatcttcgagtttggcgtatgaccgatagcgaggaaaaaaccatcgatggcaatgtccaccatctcttcgtccggctctcctttgcgtttcaccagatgagcaccttccacaccgttttcgccgaatagacccacggtattatgttcgaagagaacggttatgttcgccgtattcatcacacgctcctgcattaccttggaggcacggagatagttcttgcgtacgatcaggtacacgtgttcagccagcgatgccagatagagagcctcctcgcaagcagtatcacctccgcccactacggctactttcttcttgcgatagaaaaatccatcacaggtagcacaagcagaaacacccatgccggcatatttggcttcatcggccaagcctaagtatttggctgtggcacccgtggagataataagcgtatcggctgtgatttccttttctccgtctatcgtgatcctgtaaggagccttgctcaaatccgcttttgtagcgatacccgaacgaatgtccgctccgaagcgggttgcttgtttgcgcaggtcttccatcagttccgtaccggtgattccttcgggataacccgggaagttttccacctcggtcgtagtcgttagctgaccgccgggttgtatcccttcgtagaggatggggttgaggttggcacgagaagcatagatagctgcggtatagccggcaggtccggaaccgatgatgagacagcgtgcatgttctgacataatgatcgtttgtatttgttcgttagtaagtattgttatggatgaaacaaagatagtagccttttcgtttaccgagcctatccgtcgaagcatacgaccgctctattttgccgaaaaactgctaacaaaaaagactgtgctacgaacaatcgcaacacagccaaacacattaacaacaatctctaaagtcagagccgaaagccggactcgaaccggcgacctattcattacgaatgaat

SEQ ID NO: 686 - DNA (genomic), 463 bp, PORYPHYROMONAS GINGIVALIS; double-stranded, circular
  misc_feature 1...463
  hypothetical: NO
  anti-sense: UNKNOWN
gctccttgcgagcattctcgtgtttggctcgatggcattcgcccaagttcccaaaggaaatgacaagtctaaagacgaacacatccttacgtgggcgttgccggaagagttggtgatcgataataacagtattgtagctacttataattctttattgactccatttaatggaatgaccatggcctgcgcttctttcttcgatgtgcaggatttgttgccttatgtgggctatacgatcaatagaatagacttccaccctacggcagatgagaagaactatgagcaggtggcagccagcaagttctacatctgtatatggggcaataaggaacagacagaagtcctgtacgagcaggctctgcccacgatccacaaggaggatttgagctttggctatggagtggacggcgaggaagactattacgatgagccgatgtaccttgccgaactggaaacgcccttt

SEQ ID NO: 687 - DNA (genomic), 2240 bp, PORYPHYROMONAS GINGIVALIS; double-stranded, circular
  misc_feature 1...2240
  hypothetical: NO
  anti-sense: UNKNOWN
gagaaaggcctcgcgctttgatttcgatccgtcgaactttcttaagtaggtcgcttgtctgcacttatctctgattaagggacttctactttgttcaggatctcattgacgacagcatccggagtcaaactattagcctctgcctcatagctgagtccgatacggtgacgcatcacgtcatgacatacggcacgtacatcctcaggaatcacataacctctatgcttgatgaaggcgtatgcacgtgcagccaatgctaaattgatagaagctcggggcgaagctccgaaactgatcatatctttcagagcattcaagccgaattgttcgggatagcgcgtggcaaaaacaatatcaactatatattgctcgatcttctcatccagatacacctgccttatcacttggcgcgcttccagtatttcctccgtagtgattatcggacgaatctctgccgaccggccaccgatattctgacgaatgatctgcatctcctccttcttttggggatagtctatcagcaccttcatcatgaatcggtctacctgtgcctctggcaactgataagtaccctcttgctcgataggattctgggtagccattacgaggaaaggctcagggagcttgaaagtcgtttccccaatggtaacctgtctctcctgcatcgcttcgagcagagcactctgcactttggcaggagcacggttgatctcatcagccaaaataaagtttgcgaaaatagggccttgctttacttgaaattcctcccgtttctggctgtacatcatggtacctaccacgtcagctggcaagaggtccggtgtaaattgtatgcggttgtacttggcactaatcagtccggccagagttttgatagccaaagtcttggctaatcccggtactccttcgagcaggatatgtccatcggccaacagtccgatcagaagcgactccaccaaatggttctgtccgacgatattctgcgccataccgtgcgtgatgagattcacaaatgagcttttctgctcaataagctctgtgagagccttgatgtcaatgggtttcactcatttttttctatatcttttcttgctaaatactaatgaagattatgcacaccatctcatgttgagatagacatatagcatcctgcagggtttaagcgcgaagttcagccaacggccagcattcgctcgatcgagagcaaagccttctccctgatttcagcaggcacctttacttcataacggttgtggcggagagcttccaagacctcccacaaacctgtttgtttcatatgaaaacagcggttgtcgggttgaatggcaataaacgttttacccggattttctttccgcaacacgtgtagcgtctccggctctgtcgcaataacaaacatttttttgtcggactcccgagcatgattaagaataccggccgtggaatacataaagcagcgatcgctactcagcactcgtggcgaatgagagccctcgctctccggatgaatgagaatatcagcatcgggatacagctccatagcctctaagatggattcttccgtaattcgctcatgtacgaaacacgaagcattccaaagttccatctcccgtcctgtctttcgcgagatataagctccaaggtttctatccgggccaaagagaatttttctgtctcgaggcaagctctccactaccttgagtgcattgctgcttgtacagcagtagtccgtccaagcctttacctcggcagtcgtattgacatagctaacgatgagtccatccgggttctgctccttccaccgacgcaagccttcagcagaggcaccttcggccaaagaacaaccggcgtatttcgtgggagtgaggatagtcttctgcggcgaaataatcgaagccgtttcggccatgaagtggactccgcaaaagagtatcgtatccgcctccgtatcggcagcctgacgggacagaccaagagaatcgccgatataatcggcaatgtcctgcacctcagggcgtgcatagtagtgcgccaaaataatggcattccgttctttcttgagaagttctatctccttaagaatatcctttgtttgcatacaaaaaccaacttaaagcttactgagtaaggaggaaattcatgctgatgtccatggccgtaacgctatgagtcaaagcgcctatgctgatgtaatcaacacccgtttctgccacactttgcagccgttcgagtgtcatatt

SEQ ID NO: 688 - DNA (genomic), 526 bp, PORYPHYROMONAS GINGIVALIS; double-stranded, circular
  misc_feature 1...526
  hypothetical: NO
  anti-sense: UNKNOWN
tctcctccgaataaccctccgtgtggctttcgagcaatctgtcataggcatcgttataagcattctgcccgttgtagaatacattatagcgcgtagtgaaattgtgatagaatcgggatgccgccgtattcttcgatgtggagcaggacagcataccgaatacgacagctaccgggatgagcagatagaatacgaggaggtatagaaatctatggctacgcatggacaaaggacttaatcgttttggctaaaaggaacaaggccaccagcaccagaatgatgaaggctccggaagggatccccaacctataactgccccagagacccgtgaaggctgccaaagccgccaagattacagaaccgaacaggatcgaagagaagtgcgaagtgaaaagattcatgatgctctgaggaagggtcaggagcgacatcagtagcatgatacccaccaaacggatactgagcacaatacccacagccacagccacggacattaagcatcttcacgaggtgaaccctaattcct

SEQ ID NO: 689 - DNA (genomic), 552 bp, PORYPHYROMONAS GINGIVALIS; double-stranded, circular
  misc_feature 1...552
  hypothetical: NO
  anti-sense: UNKNOWN
ggctgccttgtcgccattcatatctccggcaacaattacgatatctgcttttttcggtttggctttcccgttcttccttgctgctcaggtcgggatggttatatattgggtactgcgaggcaagattgtttggtttataggaaatgcccttttgttgcttttcacatggggcaccatcgacacttatataccgctgcatcgaaagataaaagagtcctcgattccgcagtcgcgtatcaaggtgatgacctataacgtcaagggattcgattttcgtgctcacaattcagagaatcccaatcctattctcaaatatatcaaaggaagtggagccgatatcgtatgcttgcaagaggcagtactgagtcggaaaagcaactctcgttatgtggggctacgtactttcaagaaatatcttcccgaatatcgctacatggaactggtcgcatgctcgagaagatagaaaaggcagcggccttatgctcctgtccaaatatnccatctcggatgtgcaccgcattccataccgagtccgcattcatggcttcacag

SEQ ID NO: 690 - DNA (genomic), 2072 bp, PORYPHYROMONAS GINGIVALIS; double-stranded, circular
  misc_feature 1...2072
  hypothetical: NO
  anti-sense: UNKNOWN
attttggggctgaacgacatgtcgctttcactcacttttatagggcctgaccactgaaattcgggatcattgtcgacaaagttcgacaagaaaccgatatcgctttttcccccttgtttattcatttcgaataccacacccattagcggccaggcattgtgacccatggattcagaggtgctacccaatgagagatccaccttgtcaattttcttctctccatcttgactgaagagtaagtttttattgaaattttgccctccattcagagagaacacatagtccacaaaacttattttgtgcgtattgttgaagccggtgtaagcgaaagccaaagcaaaagggttgccaccattgttaagagaagaaggcgaacgatagttggaggctatatccacatcgtacaactgcacattggagaagtcttccttatacacgagtttcgcattctgcgcgttggcatcgcgactgaagaccgcaactctactcttatatcctccgggcttattcatgagctctaccgaccaaatcttgatgtcggattcattcttacccgttaccacgatatcgaagtcttgaaactgataatcatccgatggatcccaatccctcaacttttggtatgtggcaccttggtctttggagcggaagatcttcacattgctattgccggtgtcgtatccactgtgggtcattacatagatccatccgttgtccgccacactcatcctcgtttgtaccagtttttcctgattgtactggaccaccttgacatcatctcctcccatcgtctgcgcttgggcgagaggacagagggttgcgacggcgaaagccgccaccacgaatttgcgtaaaacttttgtcttcatagtttttgtcttttttttgagactcaatcggacaggagccctccagtctcttgaattgttgattagcgattagtttgttatcttgattttcacgagagcacgatggctcatgattctctcttcaccgttttcgttccttgtttttactttttactgattgtattatcgttcacccatggctaagagtgtccaaaatcgaaatcggcaattcgcacaacgcggaatgcatgttcggccttctctgccacaaaggaacggagtggcgaggagatatacttggacaaatcgcgcattttcttggacaaatcacgcatttagcaataaggaaacaacaaaaaacatcttcgttttggacaaatcgcgcacaaaaaaagcgtaaaacactaataaagaagatattacgagtacaagtgctaaaaagctcttttcggatgtcttttagagcgtggagaagtatccttttgcaaggaaaaagagatcggccaattcgctatcggatagagatgcggaatgctcggaccaaggagggcggaagaaacaagaaaagaaaaacaaaagagatgtcttgcgcatgtcaaaaaaacatctacctttgcaccgtcttaattaggtagggcgacaatgaatgatgtcactgtaagacgatggcgagatagctcagctggttagagcgcatgattcataatcatgaggtccccggttcaatcccgggtctcgctaccgaacaaaaagcatgccgagaccaagtgtttcggcatgctttttatgttatatacctaacattggggcaatagaaactgcatctgactccaacgggtaagaaaacaggtgcatcgtcccaaactgaaatgcagcagattatattatgattggagagagtcggctcatgtaaaccggaaggaagccatcaataaggttaacgaaaaacctaaaaacactccaatggaattttggcttatatttgccggcacgttcaccaaaaaacgaacaaatatgagaatgatgaaacttacagccatgatgctggcccttttgtcggcactggcattctcgtcttgcaagaaagacgaaccgacaacgctggagaagacccaatgggaaagaatgctgaccggcacagaaatcaataaaatcatcgcattgatggatggagagatcgacgcggactctcaactaccggaatcggcaaaactaaaattggaa

SEQ ID NO: 691 - DNA (genomic), 855 bp, PORYPHYROMONAS GINGIVALIS; double-stranded, circular
  misc_feature 1...855
  hypothetical: NO
  anti-sense: UNKNOWN
gcgatttattttgtggggtgcaattcatggagtggcactggccgtacacaaactctggtgcgagatctttccgtcgaatcgggctatgtccacggatatgcctttttggcgcagatggctcggacggatcattactttccatctcgtctgtttgggttggatcttcttccgatccgattcgatggcggtggccggacaggttcttggacaaatattcaacgacttccatcccgaagttttcttccaattcattgccggctacaagggcgttgtcgtactgatggtcataggttacctgttgcattttgtcggtaagggtaagcgaaacagggcgcaatccatgcttgagcgtgctccgttcgtcttgcaaactctgatgctcgttctcctgatcttcatcatcattcaggtacgcagctcggaaatacagcccttcatatatttccagttctaaatattcttactgcggtctcctttcatctaagtgaacgataaggatatgcctgttaggactctataagttcggcaatcttccaaaatgagactgttgcatgggagtttgattgagctcttttgctgcagagctgattcttagtgtcttcgggaaaggtcaaacctccggtatatgggcaccgagcaaatagaaatttccccaggtttccattagagaagtactcctttcctcgtcaaataggcgagaaataagaaacgattgtcagccgtttcttgctccctgcatgatgcaggacgcgattgtcggctgtttcttgctccctgcatgatgcaggacgcgattgtcggctgtttcttgctccctgcatgatgcaggacgcgattgtcggctgtttcttgctt

SEQ ID NO: 692 - DNA (genomic), 922 bp, PORYPHYROMONAS GINGIVALIS; double-stranded, circular
  misc_feature 1...922
  hypothetical: NO
  anti-sense: UNKNOWN
cttcgatgatgcttggagtcctctcagatcactgcgtagatggtagcgtgctctttgcatccctgctgcgggctatcaatatcgaacctatcctcgttcggatgcccggccatatgttcgtcggttattacacggatatatccaaaaaagaaaaaacattcctggagacaacgatgatcggtgatgtcgatttggacgactttttccctgatgagcagttggattcgacgatgataggcaaatcccaaaatcagatgtccaagctgactttcgagaagtcgaaagaatatgccaacaagaaatatcaggaaaacgaagctgacattcactccggcaagtcgggctatatgttcttggaaatatccaaagacgtgcgaaggcgaatccaatccatcggcaagtagcatcgcttttgccgcatcgtccttttgaaataagaatacgccggattgctatgtggcttacggctatgcaggctctcagtacacctttctgacataaaaaagtgtgccgaaaacgctgctgaagcgattttcgacacaccctcattccttatgcttatatgaaaagccgcactgcggatagcgtaaactccgaaagacaagatttgaggattccaccacctttgtaatccgctgtgcaaagcaacccgaaaggtgcggcccgccatcagcgatgaaattgtcctcggaatagttgttatgatgagtttccccgatctaacagtgcggcttattcctcgtcttctctgtattgcaaagttagcaacattgtttagatttgcaattctttgtttcatcgattttgggtatggttacactttcggatcctaatcggcgttctcgacgtatcaaacgtattacgatagttcggttgcttaggtaatctgctttgacgatcggggaagttttctccggtttgc

SEQ ID NO: 693 - DNA (genomic), 2796 bp, PORYPHYROMONAS GINGIVALIS; double-stranded, circular
  misc_feature 1...2796
  hypothetical: NO
  anti-sense: UNKNOWN
cgaaaaggtagagataaagaggccgtgagcttccttgggtaagacttatttttcagcacacccaaagcggtagtttctgagaaaagtaccggagtatctaaagagggttttttgtcgattggggggaggagatgtttgcctgtttggcaatctcttccccttctccacaatgcacttatgccggacagatacttcggttaattcaatttaggcatttcactacgaccatcccttaggaatgggcgagcgactgaagggtaagaaatggtatgagagatgctgcctactcgaagcggcgcgctatatctgcctcttcgatgatactgacgatgagcttgccgtccggcgtataggtggagtcgttcgaagcaaaagctcggccaagagatcgctggcctcttctgctgtcggtgtcttgccacaagggatggcttgatactcggctatttgggtggcaatcagttcgagcatttgttcatgcgatgatctgccatcttcgagtgtagtatggatgacatcccgcacgacatctgccgcacagtctatgatttgtacaggtgctgccagcagcgaataggaagagacaccgaggggcgacaaatcgaacccgacagattggagttcgtccacagctgccttcacggcagaagcatccgacggattgaattcgaggagttcggggaagagaagttgttgctgttcgatatgacgtcttgattcgtcggccatgaaacgatcgtaaagaatacgcttgtgtgcgcggtggaaatcgaccaaagccaaacccctactcagagtagtcaccagataacggccgcgatggacatagcagagcatatcggtggagggagtcgcagatacggcagagggagtaaaatcggtcgaggcgaacagctcttccgagcggatcggtggttctgccatcttctcggcatctcgcttggcttcgaactgcttgaagagttcgttccagcccatatccggcgattgacgccgcgaactgcggataggctccgtcagtccggtttctttgaagggattatacgatggatccagatctacgggcggacgaactacgtttttccccgggccttgataggcagggatgtcgatcagttctttgcggtcgaagtcaatggccggtactgcattgctggagctgagtgcttcacgaatgaccacaccgatgagtttgaaaatagcctgttcgtcggagaacttgatttcagttttggtcgggtggatattgacatcgatctgggagggttcaagatcgaaatacaggaagtaattgggcatcgttccctgaggaatgatcgcctcataggcagccatcacggctttgtggaagtaaggatgacgcatgaagcgtccgttcacgaagaagtattgcagggcacctcgtttgcgagcaccatcggggcgccctacgaagccggatatattggttatggggcttttcatcccgatgggtatcagatctttctccattctcttcccgaatacatcgaggattcttttcttcagaggagaaggaggcagatcctgcaccagctcacccgaatggtagatagaaaaagcgacttgcggattgaccaaagccacccgttcgtattcggtcaggatgtgccgaaattccgtttcattcgatttgaggaattttcgacgtgccggtacattgtagaagaggttcttcacacaaagaatacagcccagtggagaggtgacagtagccacttcgcctacttcggagccattgatggtaaggcgcgtacccaattcatcttcagcccttcgggttaggagttccacttgtgcaacggctgcaatcgaagccagggcttcacctcgaaaacccatcgtccgaaggctgaacagatcctgaaaagaagctatcttggaagtggcatgtcgctcgaaagccattcgggcatcgctttggctcatgcccttgccgttgtctgtgacgcgtatcaattcgcgaccggcctccctgacatccagcctgataatggaagcgccggcatccaatgcgttttccaatagctccttgacgaccgaggccggacgttggattacttcaccggcagcaatttgattggcgatactgtccggcaggaggcgtatgacgtcgctcataagatgaccttaaaaaccaaccacgatagcaaacaaacggctatgagcaaagccaacgtacggagtgttcgtcccgagcgagtggattgtgtctcgccttgcagctgtcgctccttcagatgctgggtaccttccacaaatgttccgcgtatacgagggcgatagccggagtagtcgtgtgatgaagactgtccgtccagctctgcttgctcctcctgttctacttcgcgtctaatgcgttcgatacgtttctccaactcatcgcgtcgctgatcgtaatagataggtttgtggtcaaaagaccggggcttacgctgtttatagaatgatcctaatcccatagtttttctctattaaagatgaatggagtgaagaaaagatcgaagaagccttcctctttggtgtccgtagtaggtcgggcaatataaggagagagccggtctgtaggatcggtagcctctttgccggctgcaggtgtcggaggaatggagtcggtctgtagggcagcgattgtcaatgagtcttttctctcctcttcggccagagcccgtgtatgcacgaagggctgccaaagcaccgctnaagcgtcgcaaatcggacagcgatccgatgcacctgcaaagacggaatcccggctggcctgcggaaaagatcctc

SEQ ID NO: 694 - DNA (genomic), 3025 bp, PORYPHYROMONAS GINGIVALIS; double-stranded, circular
  misc_feature 1...3025
  hypothetical: NO
  anti-sense: UNKNOWN
tccaggacggatacgccgcatagctcccaaccatgcctctgtgctgatcacgggcgagagcggtacgggcaaagagttgatagccgaagctctgcaccgtgggagcaaacgagcctcagccccattcgtcaaggtcaatttgggtgggattcccgaaagtttgttcgaaagtgagctgttcggacataagaaaggagcttttaccaatgctttttccgacaggaaaggacggttcgagctggctgatggcggcacgatctttctggacgaaataggcgaactaccggtcggcaaccaagtaaaactgctgcgagtgctacaggaacagacattcgagccgttgggcgagagcgtctcccaccgagtggacatccgtgtggtatcggctacgaatgcttccttggagcgaatggtagccgaaggacgtttcagagaggacctctactatcgaatcaacctgatacatctgcatctgcctccgctgcgtgagcgtcaggaggatatacagctgctggtggaagccttcagtgaagcctttgcccaatcgaacggattgccccatgccgtttggagtgcggaagctatgcgacgtatctgtgccatgcccctaccgggcaatgtacgcgaactgaaaaacgtagtggagcgtacgctattgctctcgggatcgagagaaatcagtgcccgggatgtggctgacttcggttcgcaggtgacggcagcagaccactccgacgaacgggctttgaccgacatggaggaagctgctatccgagagacgctgactaaatacaacggcaacgttagtcgtgctgcacgagccttgggattgagccgggcagctctttaccggcgaatggagaaatacggactgtgatagtgtgtaaaaacagaatcggcacgatgaaacgattgggcagaatatccctacgcgttttgctcctggcaggagtattgctctctctattgcttatggcgatgactctcctatatcctccggtagagaaaggcgggctcttcttcatgctggctatagaggttgctctcctcttctttctcggtttcctatataataaggtagtattgccgatacgagccgtaggcgatggaatggatatgctccgttcacaggactatgccactacccttgctcctgtcggtcagccggatgcagaccgggtggtcgaactttataatgcgctgatgcacagccttaagaaggagagactgagactggaggaaagggacaatttcctttcgctcgtgatggatgtttcgcccgtgggcttcgtcgttttggatttcgacatgcgggttgtatcggtcaatcctgccgcacgcaggctgttggacttacccgatgattatatcccgatcgaaagaccgttggaagaagtatgcgcgaagatccctttcggtccggacgagctgggcgaaggggaatcccgtacatggcgattgcctacggccgaggtgaggaggattacgcggatgagattcttcgatcgttcgttcagccgtctctttttcagtatcgaaaccctgaccgaggagttgcattcggcggagaaagaagcctatgaaaaactgatcaggctgatagcccatgaggtcaataacagtaccgccggtataatcggtgtgctaaatgccgtgggggatgctttcgacgacactcctcatactcccgaaggggaagtgtccgaagccatcgctctctgccgcgaccggtgtatggccattgaagtcgctttatcacacgatttgccgaagtggtcaagctacctgatcctaccctatcttccgtagacttggtaccgctatgcgagcgatgcatactgctgatgcagcctttggctgtcgaaacgggtgtgaaaatgaagatgtgcaaagagcaagattcgtgcttagtccgctgcgatgcagagcaaatagagcaggtggtgatcaatctgctgcgcaacgctatagagagctttgcacagcaaaatgatctggctgtctcggcaacaaagacggttctgctctgtttggatcgtcacaatctgctcgtagaggataatggacagcctatcagcgatgacgttgccacccgtctctttacaccattcttcagcaccaagccgaatggtcaggggataggcttggtcgttattcgcgaagtactgactcgccacggctggtccttctccctgaccaccgatgccgacggccgcactcgcttccgtatggcgtggccttgatgcgatttacctctttagttcgctgattaccctttccaatagggctacaatttgtgaggatggaatgtttttgtcaccttagcacgtccgttttcctgatttcttctttttttcaggaacgattcggacaagtattcattatgtgatttttaggtatggacaatcagaaaagaccttttacgacgcgtttcgatcattataactacaacgtcctcaacctggagcgtagcctggctttctatgaccgcgctttcggctttcgcgaagtgaagcgcaaggaagcggccgatggctcgtttatcctcgtttatctgggcgatgtgtacgggcattttcttttggagctgacttggctcagagatcggaaggaaccttacaacttgggagagaatgaggttcacctctgtgtccggactacgggcgactatgatgccgtacgcgaatatcaccgtgccatgggctgtatctgctatgagaatgagcagatggggctctacttcgtgaacgatccggacggctattggatcgaggtgctgccggagaatcgggattgatggttcggtactgtcggatctctcgatgccgtgcgttccgaactgctttgaggtgccgtttcttgaagattagatgatttcattatgctttctgccaatcagataaaattcttgcgaagcctgcgcgaacgaaaatatcgtttgcgagagcaagctttcgcagtggaagggcctaagctcgtcggcgagatgctgcctttctatcgctgtcgtatgcttgtcggcacg

SEQ ID NO: 695 - DNA (genomic), 1858 bp, PORYPHYROMONAS GINGIVALIS; double-stranded, circular
  misc_feature 1...1858
  hypothetical: NO
  anti-sense: UNKNOWN
acgtggtaggtacggggacgatagaagagatcgctttgcgtatcgctcccattgtggacaagttccgcaaagtctctaactaaatccatcgtatggcagcagagtccaatttcgtcgattacgtcaagatatactgccgttcgggcaagggagggagaggctctacgcacttccgcagggagaagtatatccccaaaggtggcccggacggaggcgacggaggccgtggcggacatgtctttctccgtggcaatcggaattattggacactgctgcatctgcgctatgaccgtcatatcatggctacgaacggacagagcggcggagccaagcgaagtaccggagcgaacggagaggatcgtatcatagaagtcccctgcgggacggctgtttacgatgccgatacgggtgagtttatcacagacattaccgagcacggacagcaggtgatgctgctccagggaggccgaggcggacacggcaatacgttcttcaagaccgctaccaatcaggccccccgatatgctcagcccggcgagccggcacaggagcgtatggtgatcatgcagctcaagatgctggccgatgtcggtctggtcggatttcccaatgccggcaaatcgacactgctatcagtgctcactgctgcaaagccgaagatcgccaactatccgttcactacgctggaacctaatctcggtatcgtagcctatcgagacaagcgatcctttgtaatggcggacatcccgggcatcatcgaaggggcttcatcggggaaaggactgggactgcgtttcctgcggcacatcgaaaggaacgctttgctcctcttcatgattccggccgatacggacaacattgccaaggaatacgagatactcagtcgggagctggtggcatacaacgaagagttggcacaaaagcgcaaagtgctggccataaccaagtgcgacctcatcgacgaagagctgtgcgagatgcttcgggaggagctgccgacaggcttgcccgtagttttcatttctgccgtggcacaacagggactggaagagctaaaggatacttgtggaaagaactcagcaaggagacccttcacgagccggacagcatagtacgccaagctcttgatttgaccagtcttacatgggatgaggaggacgatttgttccggcatcgatagaagacgacgaggatgaagaaggtctcgacgacattgattttgatttggagatcgaatacgatacgaaggagacgatgcaccgggatcagctttgacgtacctattctgcatcattgtccggcttttcgcgtaggagtggtacggccaaagttgcagcaggccggtcgccatccactcttatagatgagatgaacggagaggcttgatcggctgatacagacttgcgacctcccggccatcaaagaaatccctgccatagcagccacacgcagctgctacaaacgtaccggcaaggatcctaaccgctacaggccgtctgccgagcagttgtcccgacgtgtagtacgcggattggggctttattatatcaatgctttggtggacataggcaaccttttatctcttcgtacagggtactctatcggggtattcgaccgtgataaggtaggctccgacattgtattcggcgtgggatatgcagacgaaccttttgtcggaatcggacgtggcgaattgaatatcgaaggcctgcctgtctatcgcgacgagaacggtgctttcgccactcctaccagcgaccacgaacgaacgagcgtggacgacatcacgaagaatacgctcatattcatcaatgatttcggtgtggatcggactcattcggactgtctcgaagaagca

SEQ ID NO: 696 - DNA (genomic), 609 bp, PORYPHYROMONAS GINGIVALIS; double-stranded, circular
  misc_feature 1...609
  hypothetical: NO
  anti-sense: UNKNOWN
aggatccccagcctcaagcccaagaaaggacgcttcctgagcaaagaaaagcgagccgaagagtgggagagcggtaaggagcggttccgagaccttgaggcttggtcgcacagtgctgctcgtcggatagaggatgcttttgtcggaatcgagtatgcaagttgggaaaataagaagaaaatcgagcagctgttgcaggatctctccctttgggaaacctttgagagcaagctgaaagtcaaggcagacaagataaatattgccaaactgaaaaaggaaatnctcgaagccaaagaacacccctatcacgacttcaagtcgtggcagaagttcgagcgcgaactgcgccttgtcaagaatcaggatattatcacttggatgatgtgcagggatctcatggaagagaacaaggtggagggattggataccggtactctctacctgaaagatattcggaccgacgtccaagagcaggggagcctcaatgtgctgaaccacgtgaaagccgatgcgctttgcccgtggtcgtgtacagaagccgacaggccgaaggccatgtacacaaggaggaggcttcctctggcgacggtctatatcgaagaaagggac

SEQ ID NO: 697 - DNA (genomic), 727 bp, PORYPHYROMONAS GINGIVALIS; double-stranded, circular
  misc_feature 1...727
  hypothetical: NO
  anti-sense: UNKNOWN
gccgttctacggcaaggaagcgtaagtatgtcaccagccggcatattcacgaccgtctgatgcgagaactggacaagaatctggctctttcgtgtggagaccaccgataacgccgacagctggctcgtattcgggcgtggcgtactgcatctttccgttcttatcgagaccatgcgccgcgaggggtacgaacttcaagtggggcagccccaagtgatcatcaaagagatagacggcgagcggtgcgaaccgatagagcttctttcgatcaatctgccggaagagtcctccagtcgtatcatagacatagtgacccgtcgcaagggagagatggtgatgatggaaaacaagaacgaccgggtgtttatggagttccatatcccttcacgagggatcatcggactcaacaatgccgtactgacagcatcggcaggagaggccgtaatcgcgcaccgcttcttggaattccaaccgtggaaaggggagatagagcggcgcagcaacgggtcgatcattgcgctcgaaagcggaacggcctatgcctatgccctgaataatctccaaaagccgtggacgcttcttcatctcttacgcaggaggaggtctatgccggtcaggtcgtaaggcgagcacacgaaaggaagggcgatcttctgcgttcaacgtctgcaagagcaaaaagcttaccaatatgcgtgctttcggtagccgatgataagtgtcactg

SEQ ID NO: 698 - DNA (genomic), 635 bp, PORYPHYROMONAS GINGIVALIS; double-stranded, circular
  misc_feature 1...635
  hypothetical: NO
  anti-sense: UNKNOWN
cggagcatcgtggttagtcgtgttgttggcgtatgccagggcaggtgggtctgtagtacttccggccaacattcccatcagcgtaagataattgatcttatatcctttgcaagcgataaatccgatgataaggagaggcaggagggtgattataaaaccgtatccgatccatgtaaaaccacctttgtttactatcgtatcgacgaacccctctccggcccccaatcctacgcaagccaagaatatggtgatgccgatttctctcaacatcaaattggcactgggagtcgtataagtcaccagcttataccgataaccgaaccgactcaatagaatagccaccaccaatgggccaccagcaagtcccagcttgacgggctgaggaataccgggcaaaacgatcggaagcgaacccaaaaggataccgagaccgatgccgatgaatatggacattaggttcggttcgttcagtcgtttgacagaattaccgatcagttcttccactttgggcattactaactcactgcccactacagtcagacgatcgcccacctgtagcggaagggaagccaatgctaccatctcaactccggcacggttcacacgtgtcacattcatgccatgcattttgcgta

SEQ ID NO: 699 - DNA (genomic), 554 bp, PORYPHYROMONAS GINGIVALIS; double-stranded, circular
  misc_feature 1...554
  hypothetical: NO
  anti-sense: UNKNOWN
ggaaaattcttccgattctcgaccctgaaaatagattttttggaaagcttttgaataatatgtctcaacctatcaatgacttataaagggtcggttgggaatacccttagttagaagggtggagacaactcccatttttgagccaaatctgatacaaatgttgggaatacccttagttagaagggtggagacaactacaacatctttagtaatttctttagtaatgttgggaatacccttagttagaagggtggagacaacgttgtcccaagcctgaacggtagcgttgtcgttgggaatacccttagttagaagggtggagacaacaaacgcatcgttataagtttttgtgattgcgttgggaatacccttagttagaagggtggagacaacgttgtcccaagcctgaacggtagcgttgtcgttgggaatacccttagttagaagggtggagacaacaaacgcatcgttataagttgctgtgattgcgttgggaatacccttagttagaagggtggagacaacacctttgcttgcacatcctcaggaccaga

SEQ ID NO: 700 - DNA (genomic), 577 bp, PORYPHYROMONAS GINGIVALIS; double-stranded, circular
  misc_feature 1...577
  hypothetical: NO
  anti-sense: UNKNOWN
cgctcttctataaaatgcgtgatgtccattcctttcagattctgttctttcccgatacggaacaaacgctccacctcgcgatccagacgatgaccgatctgctccagcaggatatgcgtatcggacatattgcgcggatgctgtccgacagaggtaatttcgtcgaagatgccatccacattggtcagattgaaattgccgcaaatggacaagcacttggcacgccagttgctgcggcgtatcatcggatggacgaaagtcagaccgctctttccggtagtgctgtagcgcaagtgtcccatgtagcactctccggcatacggtatctgagaggcagcaaattcggcatcgcccagctcttctcgagaataagcctgaaaatccttgtgtaccgagtcgaatatctccgagatggcatttgccccaagtgctctttctctgaagaggtattcttctccgggacggctgttgagcttcaccacagcgagcccggcaccttcctgacctcgattgtgctgcttctccatcaggaggtatagcttgntcangccatacatccatgtgccatacttatcgg

SEQ ID NO: 701 - DNA (genomic), 887 bp, PORYPHYROMONAS GINGIVALIS; double-stranded, circular
  misc_feature 1...887
  hypothetical: NO
  anti-sense: UNKNOWN
ggatctttcaaccccatctgtatagtcgtacggcagacttttatcaggattttgccagaagcctttccatgttggatgaggtggttttattggacatttatccggcacgagaactccctttgccaggtgtgaccagtcgtctgatattggatttgatcgagaatcccaataaaacgctggtgagcaaaaacgatctgctcgattatttacacggcaacgagatacccgatgtcgtattgatactcggagccggcgatatcgatcggttagtgattcctgtcaaacaatatctccaaactttatgctaaagaaggttctttatatactggggttctttcttgtactggcctatcttgttgcagccatagttttcttttcggactattccgatagcactcgctgctcaggtttggaagttcgagtcgagggtaagacgaaacatgcattcatgcaaaagaccgatgtggagcgagacttgaagcgtctgggtttcaccccctatggcaagctgctcgactctatcgatcttcacagaatggaaagaaaccttcgtgctaattcccttttccgcggagcggaattgtatgcctctccatccggccaactgtatctgacagtggaacaaaaagatccgctctttatggtagtacgatccgatacctctttctatgtttctaccgacaggagcgtgatcgttcccaacttgcagtatgctgcccccgtactgatggcctcaggggatatatctctgtccttagctaccggccctctcttcgacctcattgcatttatcagcgatgatccattctggtcaaactttttcgctcaggtttatgtgccggataatggtcagatcatattagttccccgtctgggcaaaactgaaa

SEQ ID NO: 702 - DNA (genomic), 556 bp, PORYPHYROMONAS GINGIVALIS; double-stranded, circular
  misc_feature 1...556
  hypothetical: NO
  anti-sense: UNKNOWN
agatcataccggatataaatgccgttggatgtggcctaaagttcgctatcgcttcggtttacatggtgaaaattcttacctgaaagtgccgactaaaggcggtgtatatcaaggataccatatcgtaggtgctgtattcggtataggaatcccgctcaatgacagacgttcgttcgtaaatgtctctcttgaatatgaccgattgatcccgaaggagggtatgatcaaagaaaatgctctgaaattgaccttcggcctcacgttcaacgagtcatggtttaaaaagctgaaactgaactaacagaaggaaaaatgttgaacattaaaagaataaagaagaaaatgaatgcaagaaatttgtttgcaacggcagcactgctttttaccgcaagcacagcctttgctcagaccggagtccaaacaaataccccattcggtagtggagaagacagcatccgttgccgtcaaaacataagtctctttacctcttatgcgaaaacgggtaattacaaggatgcctatgatttttgggagaaagcctatgaggagtgccccg

SEQ ID NO: 703 - DNA (genomic), 1749 bp, PORYPHYROMONAS GINGIVALIS; double-stranded, circular
  misc_feature 1...1749
  hypothetical: NO
  anti-sense: UNKNOWN
gccgtcagtgatattgatttttccatcccttcagggcaaacctatgcgctggtcggaacttccggagggggtaagaccactatagcccgactcatacctcgcttttgggacgctacccaaggccatatacgtatcggtggagtggatgtaagggatatggcaaaagaagagctgatggacaggatctctttcgtctttcagaataccaaacttttcagaaccaccattcgtgagaatattacctatggcagtccggatgcatccgaggatgctttggctcgtgccatcgacctttctcaaagccgtgaaattatagagcgtttgcccgatggactgcaaacgaagataggagccgatggcacgtatctctccggaggggagcagcagcgcatagctttggctcgtgccatactcaaggatgctcctattgtggtgctcgatgaagccacagcctttgctgatcccgaaaacgagaaattgatacagcaggctttgcacgaactgacgaaaggaaagacggtgctgatgattgctcatcgactgacgagcgtacagcatgtggatcgtatccttgtgatagagaagggacgaatcgcagaacagggtacccacgaagaactcctgacacaaggtggtctttacaaatccatgtgggaggaataccagcgatccgtttcttggacattatgaaagaagaaatacacacaattacctctaatcgaaacgaaacaaacctatgatacgatatttccaacaccgattcgctctctctcgtaagggtgcgcaggatcttgccaaaggcattgcatggactacggttttgaatgtcggatttatgttgcctgccatattcacttttcttttcctcgaagactatctgcaaggatccgccacacatggtatttggtattatatagccatgggagcggcttttatggcggtgctcttcgttatagctctcttccaatacacaagcctgtacaccaagatatatacagagagtgccaaccgccgcatcgccttggctgaaaaactacgcaaactcccattggctttcttcggagagaagaatctgtccgatctgacttccacgatgatggaggatagtacggtgatggagactgtcttctctcacagtataccccagctctttgcatcgttggtcagtctctttttgatcggtatagggctcttctgctataattggcagctttcgttggcactcttttgggttgtgcctgtagcagccttagcaattgtcttttccaaaaagatgttgaacaaatcattccactcgaactaccatgtcaaacgagaggtcaccgagcatatacaggaaggaatcgaagagatacaggagataaaatcatataatggcgaagaagaatttgccgagcgcttcgatgccaaactccatgcctatgagaagagccttattcgatgtgaacttgttgtcggtgccgtccttaatgcttcacatataatcctcaaactgggacttgcctctgtaatcataatgggagcttatctcttgtcagaaggaacaattgatctattcacttatttagtctttctgcttatcggatcgagcatatataatcccataagtgaagtattcagcaatttgctactcttgcagtacctcgatgtacgtatcgatcgggtgagagagatggatgctatgccgatacaggaaggtaaaacggactattctgtccggaacttcgatattatattccaaaacgtaaa

SEQ ID NO: 704 - DNA (genomic), 523 bp, PORYPHYROMONAS GINGIVALIS; double-stranded, circular
  misc_feature 1...523
  hypothetical: NO
  anti-sense: UNKNOWN
atctcatcaatcaaaacatagtatttcctgcccatatcttttgtttgctccatgatatagtcgtataggagattgggattacgatacttgatatccgattttctatcaagagctacctccacgaaatcttctttttgagctccttcctcaatcaatcgattcttaaagagagtgaagagtaggaatgactttcctgaacgtcttaatcccgtaacaatcttcaccttaccattccatcgctttgcgaataactgtgcaatgtattcatttctgtctattatcataaataaggtctcttgatgatttctctgaaattttagtcgtgtattacaactgttttgtcagtgcaaagatatttttttgcttcgaactaacaaaaaaaatagaggaacaaatctattacgatgcttttgatgtagccgaggattttgcgaatacatttcaaaacagctttgaggtggggaagaaacggaaaattaccgtctttcaaaatcgggaaccggcgttattttccggtagaagg

SEQ ID NO: 705 - DNA (genomic), 597 bp, PORYPHYROMONAS GINGIVALIS; double-stranded, circular
  misc_feature 1...597
  hypothetical: NO
  anti-sense: UNKNOWN
ctgaagaattgtaccatgtctgccacntttccgttggatgttcgctcgggaacaaaagccagattcactttcttcttcggcccgctcaaatacaatatgctacgcgcttacgacaaagggatgaaagccgaggacaacctcgatctcgatcacttggtctacttgggtgccagtatcttccgatggatcaatcgttatatgatcattccggcctccacattcctgcagcagtattttagcaactgggggctgatcattcttttgctcacgctggggatcaaactcctcatctctcctctcgcttacaaggggtatctctcctctgccaaaatgcgattgctacggccgcaggtacaagagatcaatgccaagtacccgggcanggatcaggaatccatgatgaagcggcagtctgctaccatgaatctctatcgtgcggccggtgcaggtccgatgagtgggtgcttgcctatgctcttngcagttccctttcctcatagccatgtacatgtatttccctacgactatcgacattcgtagcagagtttcctctgggcggaagacctctcctctatgatgctggtttcagctggacgg

SEQ ID NO: 706 - DNA (genomic), 463 bp, PORYPHYROMONAS GINGIVALIS; double-stranded, circular
  misc_feature 1...463
  hypothetical: NO
  anti-sense: UNKNOWN
gtgaagagccgagcgaagaagatgaagcagttcagactgaagaaaatctattatgccaaagtgctaaaatgattttataagagagagaggatattcatcgtggcagtacttttgcactaatggggaattaccaacagatgtaattgcattttgtgttgacaaaaaaagaaaacgacatgaggaagttatttttaatagcatgcttagaaatgtttatgttcggctgtctcctattctcaaaagtaactctaacgataataatatgagtttgggacaaatacacgaactgcaagtgcataatttttcgcaaattccaaaggatttgctggaaaatatggataaaatgggcgtggacaattcgtcaatactcaatgaatatgaggggagatattttaattttattttcaatatagaccctcaggtttttaatcttgtcgggaaaaaagtcggcttttggggaagc

SEQ ID NO: 707 - DNA (genomic), 714 bp, PORYPHYROMONAS GINGIVALIS; double-stranded, circular
  misc_feature 1...714
  hypothetical: NO
  anti-sense: UNKNOWN
taaaatgatgatgacagactgtttttcgccggctgcagtggctccaaagccttaccgtcactcactttctgtggaatgatgacttctcaatcggtttcaaattcgatgggggtaggttggatctaccctctattcgaagggtacacacaacttcttgtcgaagtaaaacatcttgcctccagttggatctaccctctattcgaagggtacacacaaccatagacgtaaggcatacccgtttcgatctgttggatctaccctctattcgaagggtacacacaacataagactatatcttatataaccaaattctgttggatctaccctctattcgaagggtacacacaactcaagggtcgggttcttgaccttacctccagttggatctaccctctattcgaagggtacacacaactataaaggtttgttcaaggaatgtgctaccgttggatctaccctctattcgaagggtacacacaacgatgcggacaacgtccctgtactccgtcttgttggatctaccctctattcgaagggtacacacaacagtcgattagctcgtccgccgacacgtcttgttggatctaccctctattcgaagggtacacacaacatgattcttgattggtggcttgggcgttggaaatgtgcagtagtgtggggattcttcctcgttggggctttttcgctaaatttgcaggcggacgaggtgct

SEQ ID NO: 708 - DNA (genomic), 984 bp, PORYPHYROMONAS GINGIVALIS; double-stranded, circular
  misc_feature 1...984
  hypothetical: NO
  anti-sense: UNKNOWN
cgtcgaggctgtttcggtgtagtatcggacatgtcaagagacgtatttgtaggttaggagtatgtgcttgagccggcgaaggagcagtagcggcagcaatgcgaagatgacgaaagcgaggatattggtccaagcatatttcagggaaaatccatcaagggcacttgtcacataagagagatagtagtgcctcaacggaaatagcgcgctggcggactgcatgacagtcggcataccgagagcgggaaacgaggctccgcatatggagaaagagataatgccccatagggaagcaaagctaagtcccaatctcatcgtcgggagggtgacgaacatcagtacgccaaaaccctgacaagcgaggatgaagagatacatgactatcagcatcggcaagaatccgccattgatcgggtaggagaggaagccatacagatatacgtctataaaggtgccgatgagcatgaatgccacggtttggggtagcagcttgcccaaaagggcgatggacatactgccgccggccgtctccatccattctcgagctgtcgatctcttgatctccatggctatgctacacactgtgaccatgaagatgagcagacccagtacgccgggtatcatgatattgctcaggtagatggagtagttgagccacggattgcctatggggtgcgtgtcgataacgatcggctgtagccagtccatggcctggctttcggtggctcctcgggcataaagttgcgaacgagcggctgcaccggctaccagttcgctgatcatcttgttgtccctgaagaggagcgagccacccaccatataggcatagttggtatagaaggagagcttgggcttgcttctgtgcgtaggcatcccgtgtcattccctcgggtatatagtagtaaccgtatatctcgcctcgctgactgccagccgagccttacgcacgctttcgaactgttgaccatttgggttgcttccatc

SEQ ID NO: 709 - DNA (genomic), 5990 bp, PORYPHYROMONAS GINGIVALIS; double-stranded, circular
  misc_feature 1...5990
  hypothetical: NO
  anti-sense: UNKNOWN
gtggaggatttgttgtcttatataggaagtatcagctatccgaacagcaaagcgaagcatctggtcgggatggcgcagatgctttgctctgattttggaggagtggtaccggacgaggtgtcggaactaaccaaactgcccggcgtaggccgtaagacagccaacgtgatagcctccgtcgtctacggcaaaccggccatggccgtagatacgcacgtattcagagtatcagaaaggataggcctgaccaccggttcgaagtctccgttagagacggagcgagagctggttcgctatattccggatgtgctgataccgaaagctcatcactggctgatcctgcatggacggtacgtttgtctggctcgcaagcccaaatgtgcagactgtggcatagcaccattctgccgctactactcgaaagtttttaagaagaacagtacagcccttccgaaaaaaggggaatgataaggcctgttgtgcaaataatatccgcacaaatgctccataccttaattccggaggcaatatgaatcgagaaagctttttactcctgcttggtctcttatttgctctcccgctccatctgcaaagcatcgtctccatgcaacaacatggcagatacgacttgtatatccgattcggccaaaatgtttcctcctgccatcggtgtttaccatgtaaaaccgatgaaaaacacattgcggcattccctgcctcttgtagctgcttctctccttactttcaacgtggatgacaatatccgagagcttcgctttaccggtgccgggagctttcataccaagatagacaacgtcagtcagctcgttcctcttatggcacagctttcgatgaggggattcggctataagggacgcagcaaatcatggggaaaaatgcttgtgtcggatgccttgggtatggcacttatgggtggaatggtcaatgccggaaaatattcgttcggacggttgcgtccggatggaactgctgccaattcatacccatcaggacatacggcaacagctttcgcctgcgccacactttttcatctcgaatacggctcccgaagcccttggtatagcgcggcaggctataccgtagcctcccttacggggatcagccgtatcgtgaacaatcggcattgggccagcgatgtgctttgcggagctgccgtagggatattggtcggagaattaggctattggatcagcgatctgatcttccgcgatcctacgggctacaactacaagctgaccaagaaacaggaaggaactctggagagcatggtcatttctctttctaccgggaatagatacatcaaccggcagatggactttgaaggcaagacagtagaacgtaccgacgctttcggcatgaacctgaagacgaccttcaatccgagctttgctcgctgggtacgaatcggatcgcaattcagcgtttcgacagagaagcagaaagtccttacgcgagaaaggccggcaaaagttttcgtagctccggcgatctcactcggactttctgccggtgtagaatggcatccatggcagagagcatccgtctgggcagagatcctgccctcaatactgtttcgtacagactttaccaatgcccaagacgagccggacgaaatgtcttcgaaattacaccgacgctcgagtttccaaccggcgttccaagtgggagtagcatacagggtatccgatcacatgggtatagaagctcatgcagggtatcagcttggcgaggcagtataccatcttatggaggaaacatccacttggtcgatcatcaaaaagagagctaccgtaccttaccggggatttgagtttgcagtcggactacaattctatcctttccgctgacgatcgagtggaaatggctgtacagagttcacaagcggtgagcacatcgggcacctcgcgcaagcgaacgatcctctttcctccggactgacgaatctcgcaccgacgtgtgtgcgctgcgatatattccaacaacatgccaaagacttcgctctgatagtaagggctgtctttccttgccgaccagatggaaactcatctggtccccacgcaatacgatcttctctataccgagcgaacggccgaggcgtcgcaggcgaggtacccgtatcaactcctctccctccggcggaattttaccgaaacgatcctgcatacggcgccggaatgcatcgagctcctcgtccgtggagagattgtccaactcccgataaagaagaatgcgttccgaatccaacggcacatattcttcggggaaggaaagttccaaatcgctctcgaccgttgtctccactacaaaccgggaagctgaaggaatagcttcttggctctctgcataaagatcggcaaactcatccgctttgagttcggaaacggcttcattaaaaaccttactatacgtctcatatcccaaatcggcaatgaatccgctctgctcggcaccgagtacattgccggcaccacgtatatccaaatcctgaagagcaatgcgaataccgctgccgaggtcgctgaagttctctatggcttggagccgacggcgcgaatcgtcgctcaggacactgagcggcggactcaaaagatagcaaaaggctttcctgttgctccgtcccacacgtccgcgaagctggtgcaactcactcagaccgtatcggtgggcatcgtcaatgataatggtattggcattgggcacatcgataccattttcaatgattgtagttgcgaccaacacatcatattcgtaatgaacaaaatcgaggataagtcgttccagttctgtgggcgacatacggccatgccccactgccacgcgtgcatcggggacttcacgttgtactatgccggcgatctcttctatattatctattcggttgtggacgataaagacctgtccgttgcgggacatctcgaaattgacagcttcccgaacaatgtcggggctgaatcgtgccagttcggtggcaacgggatagcgattcggcggtggggtgttgatattcgagaggtcgcgtgctcccatcagagagaattgcaaagtacgggggataggtgtagcagacatggtcagcgtatcgacattgacctgtagtttgcgcagcttttcttttactgccacaccgaatttctgttcttcatcgatcacaaggaggccgaggtcatggaatctgatatcgttgctcacgagcctgtgcgtacctataattatatcgatccgaccttctgccagatcgtgcagaatcgctttaatatccttggccgaacgggcgcgggatatgtattcgatacgcacggggaaattttgcaatctgtccctgaacgtctgatagtgctgataggccagtacggtagtcggcaccagtatcgctacctgtttgccgtctgtggcggctttgaatgcggcacgaacagccacttccgtcttgccgaaaccgacatcgccgcagataagccgatccatcggacgatcgctttccatatcggcttttacctctgccgtggcacgctcctgatcgggcgtatcttcgtacaggaaagaggcttccaattcgtgctgtaggtagctgtccggactgaatgcaaagcctcgctcttctttcctttgggcatagagccggatcagatcgcgagcaatatccttgacacgctttttggtcctctctttgagcttttgccaggctcccgtcccgagacgactcagttctacctgcgcatcactgtcaccacctttgtatttggacaacttatggaggctgtgcagattgacgaatattatatcgttatttcggtaaatgagtttgattacttcctgccgcttccctcccacatcggtcgtgataaggcctccgaaccggccgataccgtgatcgatatgcacgatatagtcgccttgagagaattggttcagctccttcagtgagagggtcactttccccgaacgggctttgtcgcttttgagattgtatttgtggtaacgatcgaaaagctggtgatccgtaagcagaacgatccgaagagcttcgtccgaaaaaccctcatgtaaggtgagcgatactcttttcggaaggagcgaagagcttccacgctcggaaaggatctcttccactctctcgtattgcttatccgaggctgtggccaaaagcattctgtagccggcatctcgccattgctccagttgatcgatgagcagatcgaaattcttgtggaacaaaggctgcggttgggtcttgaagccgatacggtaattgccgctcctgccgctgccggtggcgatggtcgtgaagtcattcaatttatccatcagctccttaggcgatgtgagccgctcctgcatggctacgagcgattcgaatccttcgccgtcatcgaagagcggagcatcggtaaataccatttgcagacgatcctccaaaaacggtctgtccggcaatacgatgatcgtattcttcgggaataaaccgagcaaacactcctcggcacgaacatctcctgccacatcaggcatcagtacgacctccgacagcgtccccaccgagagctgactctccacctcgaagagacggatgctttctatctcgtcgtcgaagaagtcgatacgtaccggtagctcgcgactgaaagaaaatacatccagcaaactgcctcgtacggcaaattgccccggctcataaacgtaatcggttcgttcgaagccccattccaatagaagatctctgagaaaatcccgatccaacctgtctccctgacggatgctgtgcatctctttctccagtatatcgccggcgaccacgcgttcggccacggcttcgggataagagacgacaagcggacagctaccctccatcgaaagagcggccaaagcctcggcacgaagcacctgttgtgccgcatcggtatgcccgtatttgatagcacgcttataggaggaagggaaaaaaagtgcactaccctctcctccgagttgctccaaatcggagaagagatagccggcttcttccatatccgaagcaatgcaaaggacagggcgaccggattcgtgcagcagtttcactataagagctgccgacgacccgcaaagcccgtcgagagctacgcacttctctcggtcgagggctttcatcaaagcctgcacaccattgtgccggcgaaagagggaaagaatatcgattggttggggagatttgatcatgagacaaaaataagcggtctgtaccaattattttagcgaaacgatattacgatccatcctaaagttccggccaaatcagattgcacgggttggtttatgcgcaagatttttctcttttgtccttcttgaaaacgtgacgtgcaccgaaaaagttgatgctcggaatcggtcaaatgtttcgacataattaacatcagcacgatagtccatttagagccggtgccatagagtggagcagtttttgtagttaatacagtgtacatttgtgtcgataaaaggcgaacaacccttttcgaccgcatcaacatgctgataatgaataaaataaaaaagtgaaagcaatataatgaacaagcaaaaaaacaatcgcgaacgaacgcctcagcccgaacaggataccgaaagagacgaacaactgacaaacagtcacgaaaatgatatagatagtgcccccgcagccgaagagaacgacaaggtggcagacccggtggagcagctcacggctcagttggctgctcttaacgacacccactgcgtttgatggcagaatatgacaactaccgcaagcggacactcaaggaaaagagcgaacttatccgcaatggaggagaaaaggtgctcgtgggatctgctgcccgtgatcgacgacttcgagcgcgccctcagcaatctgggcgacatgtcggagcctgctgccatcaagaaggagtggaactgatctacngcaagttcatggactatctgcagagcatggtgtcaaaaagatagaaccgcag

SEQ ID NO: 710 - DNA (genomic), 881 bp, PORYPHYROMONAS GINGIVALIS; double-stranded, circular
  misc_feature 1...881
  hypothetical: NO
  anti-sense: UNKNOWN
tggcgagccgatcncggnagagaatatcggtaagcgagttgctgccgatgtcgataccggccttcaccgcaggaatgcttctgtactgaacacgctggggtgtgtactcaaaggactgttcgtcctcgtaggaataggtcttatccttgctgtcgttttcggtcttttcggccttatattagagctgtttgcagacggttacgtggcacatgctcctttgacttcggactggatttctattccttcttggatgatactctgtgccacgatctccgtatttattatagtagccgtcccggttatggccatcgttttcagacatcaagggcaggggagaaacgggattattcctgcaggtctcaaatggctgggcttgaccatttggcttgctgccgctgtcctattggccgtagtcttcatattgataacccgtgaactgggtttgaatttcttcctccatcgccattcagtatgatgtcagaaatgcctaaaaaacatttaggttccttttaggacaatccatagtaaaggtttttgcgtttttgttcatatcttcgttttagaatcttgccttttgaaaaagaataacatcagctattaatagtatgagcgataattgtcatttgactgagaaatcatttcgaagtgttgtcctcccgaaggattccgtcctgactttatttttccgaatttgtctccgaaactggtattggatactcctttctattgtccttttcgccggatggggtgtggtgaagtataagagggccggcatggctcccagcacctattttacgaccgtaatggcacgattccccgaaggcgttcagagagcatgctccggtgggttgaatccaaactacaatgtatatgataattat

SEQ ID NO: 711 - DNA (genomic), 643 bp, PORYPHYROMONAS GINGIVALIS; double-stranded, circular
  misc_feature 1...643
  hypothetical: NO
  anti-sense: UNKNOWN
ttattcaaaaagttcctcattttcggacagatgctgttcttgacttgctcaatagtgttcttctcactcccttattgacagatcattcgcgtgatctcctctcgaatagggaggtaaccaagcagtactacgtaccggaggaaagactttggggcgatgaactgaccgatctgctttttagccggccggatagtgggcagcagctactcgaccggttgttcctactccttgaaaaaattgccgaaagcatgctctttcagccagccgattcggagtatgaccaatcggaggagaccaataatatggagttggagcagatctatcactatcgcaatatgctgaacaggctcagaggactggtcgaatcctatgccatggatatgtcagttcgttctgcagctcttctgttgcaaggattggtatccggagtgagcatcccattcgagggagaacctctggtcggcctgcaaatcatgggaatagatcaaacgcgatctttggatttcaaacatctgatcattctctctgtcaacgagggtaaactcccatcgcgtgtctatgaaacgacaatgataccctacacattgcgcagagggtatggacttcggtcaatgaggtaaacgaagccactcaatctatgatt

SEQ ID NO: 712 - DNA (genomic), 910 bp, PORYPHYROMONAS GINGIVALIS; double-stranded, circular
  misc_feature 1...910
  hypothetical: NO
  anti-sense: UNKNOWN
aatgaaaactgcagaagttcatcaggatcagacgatatttcaattgcttcatcatgagtgtgtgattgtagttattacggaagactgaaaagaaaaagcccttcgacggcaccgaatcccgaatcgaaaggcttatccccaattattgtagcatgtatcagttgtcggtataagtcatactgtaaacgccgatacgcgccgtcttatttttttttccgagctgtagtttgacgccggacgggaacatgaaattattcagctgggaggtgtacagcgaattggaagctcccgcaacctgacgcttcacaggcagcagtacgagaacaaggtccttggtgatataaggcttgccctcgggagtcttctccgtattgttcttgatatgctccatcagcaggcgactgatattgctaaaccgatactcccgtttcttaatgttgtatatggtcgataggaatgccgtgcgaggctgcatcagctcggtctgttcttgctcgaagaagtttctcaccgaatcctgcggcaagagcaacaagtaggagggcggactcagcatcaagccctcagatggcttcgaagcactgatattgaactgtgcttcaccgatttgccaagccaaagaggaagacagattgctcgtgaaagcatccgtaaactgctctttactgattgtcagttgcgtcatcacccctgccggactcttcacacaagtgagagaatcattctcctgcaacaggtgggatatttgggagttcttgatatgattgacctgataggattcgctcgtgtttacgaatgtctctgtagctgttgtggtggaatcggccgtaaccttgtagctatngaagatggccatctgcgtattgtcacgctgagcacaactcccgtacccgtcgtcgtagtcacatac

SEQ ID NO: 713 - DNA (genomic), 988 bp, PORYPHYROMONAS GINGIVALIS; double-stranded, circular
  misc_feature 1...988
  hypothetical: NO
  anti-sense: UNKNOWN
cgatccggcagccggatcggtgctggccatagccgaagctctgaccaatatcgtctttgctccgcttcgtaatggtatcgagggtgtgagcctgtcggccaactggatgtggccctgccgtaacgaaggcgaagatgcccgtctgtaccgtgccgtggaagcctgttcggactttgccgtcgatctgggcatcaacatccctaccggcaaggactctctgtccatgacacagaaatatgaggacaaaaaagtgctgagtcccggtacggtgattatcagtgccgcagccgaagtgacagacattcgtcgcatcgtcagccccgtcctcagccatatagccgctaccgctctctactatatcgatttcagcttctgcccgttctcattgggaggatcggcctttgcccagagcttgggtactatcggtgatgaagtccccactgtacgtgatccggaatacttccgcgatgcgttcaataccgtacaggaactcattgacaagggtctggttctggccggacacgacatatccgcaggcggtctgattacggctcttctggaaatgtgctttgccaatgtagtaggcggtctggaggtggaattggataacctcgtggaagacgacctgatcaaagtcctctttgccgaaaacccgggtatcctcattcaggtaaaggaccgcaaagccgttgataagatcctgaccgatgccggcatcggtttcctcccgatagccaagccgacccaagagcgacacctcttgatacataaagacggagccgaatacctgttcggtatcgaccacatgcgcgacgtttggtatgagtcgtcctacctgctggactgcttccagagtggcaataccttggccggcaaccgcttcgagaactataaggaacaaccggtcgtatatcacttcccaagcaatttacgggtgatctgaagcgatgggattggatcccgatcgaaagacggcattcggcattcg

SEQ ID NO: 714 - DNA (genomic), 740 bp, PORYPHYROMONAS GINGIVALIS; double-stranded, circular
  misc_feature 1...740
  hypothetical: NO
  anti-sense: UNKNOWN
ccattgtgtaatctcccccttccatcacatgcttttgcccatccacgatacgcatcttgtgatcgagattgcagtcaagggtgtccctcatactaaagatggcatcgaagaaaggtgctgttctgaaaagcaaacgagatctgaatcctctatcctgtttttcaaacgatagtgaagcatcgccggcacgtggcatcagtgccccccacttatagtagattgtatagctgaggcattctccggtcctgctgaaatcgttggagatgggttgctgagcttgcaatgatatagaggtgatgcttatgatgtatagagtcgtgaggatgatgactatgcagttgaatggatttcgtttcttgcttatattntgttttgctttcatttctccttttcttttcttccaatgattcaaatataggcaataagcggttagtagaaataaaaggaggaagcctgtgccagacctcctcctcaaaaacgaatagactctttagtagtttttgggtgtaaatactcccaaagttattttttattcgaattatagatttcgctgagtttttcgattagcttttcaccacgaagatctcgctctataatagtgccgtcaggacccaacagtatgacttgcggaataccttgnatgccatacatatccgtagccacattcttagcatcgatatctgaggccataccacgttgagacttctttgcttcagtgatcttcatttatccaaactact

SEQ ID NO: 715 - DNA (genomic), 838 bp, PORYPHYROMONAS GINGIVALIS; double-stranded, circular
  misc_feature 1...838
  hypothetical: NO
  anti-sense: UNKNOWN
cacgctatggccatagactcgcgagaagactttggtctgacggntccgccaatgcaacgatccgtatgatcagcgtggcatagccgatcagcagcagcacggagcttaagaaaccctgctcttcgcccacggtacagaagataaagtccgtatcctgctcgggcacatatttcagtttggtctgtgtccctttcaggaaacccttgcccataaatccgcccgagccgatagctatcttggactggtctacattgtatcctcctccccgcaaatcgtcctctattcccaaggcaaccctgatacgcatctgctggtggggctgcatcactttgttgaatacatagtccaccgaatagaagtagcccaccgaacacaaggcgaaaacggctatcagcgcatacgacagtacataccgcttgatggccattgacaaagcccatacgatcaatgctgccaagagaccgtatgccacgaggacaaaatccaccgacacgaagtacgacagcactatggctacggcataggtgacagcagtaagccctgccgccacgacatagaagcgtcctcgctccttggtatagatccgcacgaggaagaatcctatcacaaaagccatcgagaccacagaccattcggcggcatccgtatgtccccaccacacatcgccctgcaacttcagagccgtgacgaaaaagaggacggcacagaaggcaatgccgatgaatacgccggacattccctcacgatagagggcaaggaaaaaagctatatagacgagggcagaccccgtttcgtctgatcaggataagcagtacgggatgaggataatggcaaaagt

SEQ ID NO: 716 - DNA (genomic), 1370 bp, PORYPHYROMONAS GINGIVALIS; double-stranded, circular
  misc_feature 1...1370
  hypothetical: NO
  anti-sense: UNKNOWN
agttcagcaccgatttcgtccagccggacaccgcttttgaaagcgtacgctgctggagtatctcacgacgcaacttcaaatccggacgttctatcttgacacaggtagcaccggccatacgagtgaccaaccggtcctccatcccgttaaggtctacaggaggtttgtccgacgtcaagactatctgtttgccaagcatatagaggtgattgaacacttggaagaaagctaattgcgttttcttcttgccgatcaaccattggatgtcatcgatgatcagtacatccacttgctggtagaatgcgatgaagtcattgatcgtccccatacgggctgccgtagtgaactgcatctcgaacaaatgactcgatacgtatagtactttcaaccgggggtgcatctctctgacacgaaggcccaaggcatggcacaagtgcgtcttgcccacaccggaagctccatatataaagaatggattcatcggcgtattgcccgggctggcggcgatggcttcagccactgagcgagctacatagttgcattcgctctggtagaagttgcggaaattgagcctgctattgagctgcgtgtcgaaatcctgtgcttcgctatgggtggctgcattgggcatgtgcctgtgtagcaaattgacatcgaactgttcggctgcctgtccaccgtcggcacaaccggccaatgtcaccgtgccgggatatttgggcgaactgttgtctacaagggcattatactgtaatgatgcgttgggacctataacacgccccaacaccgtacgcagctgctctacgaaattgccctccaaaaactcacagaagaactgactcggcacttgtaaggtaagcgtatcgccctcgatagataccggtatgataggcaagaaccatgtacggtatgctcgctcatccacaatatcctgaaggatgcgaagacacgcgtcccatatttcatttacattggtcgagtggtagttcatctaaaaaaatatcgttttgagagcagtcgttcattgctcttttggggatagcaaaggttcaaacaaaagagtaaaaaaacaatcgacaaaaagtgtagtataattcagatgaatcgtatctatattgttttcagatggttataaccttgagatataaacagcgaaggaaacaacgctattccactgcattccagacacttatacgaaagccgaccaaggcgcgaccgagttatcaacacccaagacagagcctcgattcagttgtgtacaaagaggttgcgaggaaggagagaaaaatttttcaacagcatctttatttacaatgaatcgaaataaggaaaatctncggtgctccctaaaatcaggatgtatccaatca

SEQ ID NO: 717 - DNA (genomic), 870 bp, PORYPHYROMONAS GINGIVALIS; double-stranded, circular
  misc_feature 1...870
  hypothetical: NO
  anti-sense: UNKNOWN
atcttcaatccgagaaaagtgggctcagtcaatcctgaagcaatcttcacgccatcacgatagaccgtgtaggtataagaacgaacagcctgctccggcaatctcctcagtagcgactatctcctgcagagcttctacctctgcctctattgcgtctgtctcctcaaaccggtgcaacgaaagtcaatgattccaacacctcttcgttcggaataatctcttgagctgctacttccaatggcataataagcatgggtaaaaccagccaaagcagtgagcagactcttttgaagtagttctgtttcatagttatctccttttttaattagtatctcatcttgttgcttctgttcgcctcttaaataaggtgatacacaaagataaaaatatatttcgccggcaagctattcttcaacctaaaaagtttgtatgacgcaggaatcggaatcctttttcttcgacaaaattgaagtcaatcaggagcaaggaggttctcttttaggtcaaaagactgatgctacttgcttttataatgtttcattgcttccggcatatattggcgaatggcagctatccgattggcatcgctcggatgcgtactcagaaactctacccgcccgttaccttgggcagccatcttttgccaaaaagtaattgccgnattcgggttataaccggccatcgccatgaagacaagtcctattttgtcggcttcatactcctgtttccgattgtagggtagccgtaataagcacttgtgatccaatgccataggcctgcccgatgaccgtttgcagtgctgctgacttggtggagactgctgcgcccagtatattaccacccatttggcgtagatattcctgactgatc

SEQ ID NO: 718 - DNA (genomic), 692 bp, PORYPHYROMONAS GINGIVALIS; double-stranded, circular
  misc_feature 1...692
  hypothetical: NO
  anti-sense: UNKNOWN
gcgttatctctatcatagtggatattcggagcattccgctgccggcacctttccctgctaccgtttgaccggacatccgaagttcagatcgatcaagattcggaccggccgattcgcatagtcgggcaagcctctaccatcgaagccaacatcccgtccgtatatctgtacagccatcgggcgttccgattcatctatggccatttttcggaatgtgccggctacttgacgaatcagggcatcggcactgagaaattcggaataaaccagatcggcaccgaactgcttgcacatgatccggaaggctacatccgtcacatcctccatcggagcgagtagcaaaggctctaccccgaggtctatggcacctattttcatgctccttgggctatggcttgtgcctgtcgcagagccgcttgaatatcggcacatacgttttcctctcccaatagctctacgatgcctgcagtggcaagttcttcgtggacgtccttgcgcacaccggagaggacgatgctgaccccttctttccggctcattttgatcaggttttccagattgtgcatccctgtcgaatccataaacggcacatgccgcattctgataatccgaacatcgggatggtcgcccaatgtgttcatgatctcttcgaatctgttcgcgataccaaagaagaaaggcccttcgatttc

SEQ ID NO: 719 - DNA (genomic), 724 bp, PORYPHYROMONAS GINGIVALIS; double-stranded, circular
  misc_feature 1...724
  hypothetical: NO
  anti-sense: UNKNOWN
gcgcccaaatgccaaagatcggaggggaaactttcggcctgaacgtaataggtgaagaggacagggatcagaccgaaaaaaatgaagactgcgatttcgcccaatccatgataggccaaaggataaggaccggcactatacgacaaagctccaatggctacaacgactcccacgaccagcaaccaccagttgctaatggcacaaagcagaaaaccgctaaagccgagcagaaaaagaaatgagaaaagagctgcgagaacctgtcgctccgacaaccaacctttggagatcccacgttcaaagcctacacgctgatcggtatccgcacccttcttatagtcgaaccaatcgttggctatattgctgaccgtttgggcagacaccgctacgatcaaagccaaagcggcctgtggccagcgaaaattgccgtcagctatagcataagcaatggctacaacgacaggactgacagatgccggcagggtatgaggccgtagcaaagcgagccaagctttgagacgcgggggtgatccgttattgctcatctgagaaaagacttcccggtagcggacgcatattataggaagaagccatcacggctccatatgctccggccgaacgaatagccagataatcgccgcgtttgagttcgggcatgagcaattcacgctcgaatacatcgctggatcgcagattgggccgacaacatcgatttctctgcaga

SEQ ID NO: 720 - DNA (genomic), 541 bp, PORYPHYROMONAS GINGIVALIS; double-stranded, circular
  misc_feature 1...541
  hypothetical: NO
  anti-sense: UNKNOWN
ggcctcccgaggcaagagcgccaatacggccgtgatgtccttgtcattgaccatgccgaagacgatacgcagctgtcggtaagtctgtcgtctcagttgctcggtgatcagacggaatccgtcttcgttgtgtccggtatcgcatacgatccgtggctgctcggccaactgctgccaacggccaaacagccctgacattgccgtaacgtgggcaaatccttcacggacgtgttccgaagaaagattcagaccgcatcgtttggaaaggacctccacggcacagagaatcgtacgcgcgttctcctcctgagccaagccggtcagttcgccacgaaccgatccatagtcccgtgtttggtatgtatagcaaccgttttctaatgtcgaggaaatgattacgcccgattcttgagcaaagacaatatccgttctttcctcatcggctttgtgctgaaaggcatggcgcacacctcctcggctcggccgaccacaacggggactccggacttgatgatcccggccttttcgaagctatcttctc

SEQ ID NO: 721 - DNA (genomic), 727 bp, PORYPHYROMONAS GINGIVALIS; double-stranded, circular
  misc_feature 1...727
  hypothetical: NO
  anti-sense: UNKNOWN
ggcggcaggcatccccacgggcgcatcgctcggcaggacgatagtcccgtcattcgacgagcctacaccgatttccacttcggagcaaatcattccgaaactctccactccgcgaatcttggatttcttgatggcaaactcttcttctccgtgatagagcgtggtgcccaccgttgccactaccaccttttgtcctgcagccacattgggcgcaccgcagacgatttgcaaaggcgcatccgcccccacatctaccgtggtgatatgcaaatgatccgaattcgggtgttcctcacaagtcagaacatggccgatgaccaaacctcgcaagcctccccgaatcgtttcgatctcttctacaccgccggtctccagaccgatggaagtgagcgtgtcggctatctcttgcggagagagggtgcagggcaggtactccaagagccatttgtatgagatattcatctttgttactccttagttgtatatgtgcttcagagactcatgggtcaggtctcaaacgcgattattatatgtaagcccacaaatttagcgtttttctcggggagtgtttgttttatgttcgtcttgcgctggtttgcaccctccgagtgctctgcttttcgttctcccaaagattctggctttccttttccggtttggaaaaaattcggttgtatttcnggcctgtaaaacgtggttcttgaggaaatattttttggttttggcc

SEQ ID NO: 722 - DNA (genomic), 538 bp, PORYPHYROMONAS GINGIVALIS; double-stranded, circular
  misc_feature 1...538
  hypothetical: NO
  anti-sense: UNKNOWN
tgctttctcctctgaaaacacagttagagcaacaagtcaattggagttccaccgtcttcggctcttatggcagtagcgagttctttatcaacgttttcttcggattcctcatattggcagggatcatcctggaccgcatgggcgtgcgtttcactgccattttatccggcagtttgatgcttttgggtgcccttattaaggtatatgccttgagtgaagtcttcaatggcggcggcttcggctacgatatgctcaattccttttctatgggtttcccgccatctgccaagctggcctgtgtcggttttgctattttcggatgtggctgtgaaatggccggcgtaaccgtttcccgtgctatcgtgaagtggttccatggcaaagagttggctttggccatgggacttgagatggctattgcccgtttgggagtcttcgccgtgttctggacttcacctatcatttcaaagcagttcgaaggtacgcttcagagcgttcaggtaccggttatttccgttacggcactcctttcatcggt

SEQ ID NO: 723 - DNA (genomic), 763 bp, PORYPHYROMONAS GINGIVALIS; double-stranded, circular
  misc_feature 1...763
  hypothetical: NO
  anti-sense: UNKNOWN
taatcaccggagccacatccggcatcggtgcagcttcggctcgccgcttggcatcgctcgattataaccttatcatcacgggacgacgctccgaacgtttgcaaaacattgccgatgaaatcagagctgaataccctgtcgaaatcctcccgctctctttcgatgtccgcaatcgcgaagaagtagaagcccatttgggcaatttgcctgatccttggcaggccgtttccgtcctcgtgaataatgccggcttggcagcgggactcgaccccatacagtccggtgacattgaagactgggaacgtatgatagacaccaatatcaaaggactcctctacgtaactcgcacaatcagcccgggtatgatagcccgaagcgccggccatatcatcaatatcgggtctattgccggcaaggaagtttactctaacggcaatgtctattgtgccacgaagcatgccgtagatgctctttcgaaagcgatgcgtatagatatgcttccttatggcatcaaagtcacacagatttgtcccggagcagtggagacggagttctcgctggtgcgcttccatgatgatcaggccaaggccgatgccgtgtacaagggcttcactcctctctgtgcgaacgacatagcggagtgtattgcggccgtactgaacctgcctgataatatctgtatcaacgatatggtggtcatgccgaagcgcagccggcagcggacacttttcaaacaagttgatcacaaagaggccaaacgata

SEQ ID NO: 724 - DNA (genomic), 684 bp, PORYPHYROMONAS GINGIVALIS; double-stranded, circular
  misc_feature 1...684
  hypothetical: NO
  anti-sense: UNKNOWN
atgatgcaggacgcgattgtcggctgtttcttgctccctgcatgatgcaggacgcgattgtcggctgtttcttgctccctgcatgatgcaggacgcgattgtcggctgtttcttgcttcctgcacgatgcaggacgcgattgtcagctgattcttgcttcctgcacgatgcaggacgcgattgtcagctgattcttgcttcctgcacgatgcaggacgcgattgtcagttgattcttgcttcctgcacgatgcaggacgcgattgtcggctgattcttgcttcctgcacgatgcaggacgcgattgtcagctgattctgctcccatcaatgcgctaactatcagctatttgcaactattttataggacttttattgaagtcttttgccgcagagctgattcttaagtgtttttcagattacttgaggtttgcagagagatcgcatgaagctctcctttcttcgtcaaatcaatgcttgtgtctgtcttgatcgatatgaggaggtgggaaggttattgtgcaacagtctcaaaatgtgaagacgctcggaatcggtcaaatgtttcgacacgattactgatttttgacctttctgagtatcaactttttcccgtacacatcagaaatgatggtgtacagatcggatgaacagccgtttgccgattgtggtagctttcagccgtt

SEQ ID NO: 725 - DNA (genomic), 847 bp, PORYPHYROMONAS GINGIVALIS; double-stranded, circular
  misc_feature 1...847
  hypothetical: NO
  anti-sense: UNKNOWN
gtggtcgatgataacaaacatgtactgacggctttgaaattgctcctgacggggagtttcgagaccgtgacgctcctaccttcccccaagacactgctttccacgatcgtagaggtgcatccggatgtactcctgctggatatgaatttttctaccggcatcaatacgggtaatgaaggattatattggctggatcaggtccgtagccgtttccctgacctccctgtggtactctttaccgcttatgcggacattcgtctggcagtggaagccttgaagcgtggagcaagcgatttcgtagtcaagccgtggaacaacaccgagctgttggagtcgcttcgcatggcgatgaataaggccgcaagcactcaagtgacggctacacctaaagaaggcgattcggtatttctcagcaaaagcaaggccatgtgtgaggtgttggagctggctggtcgtatcggcgatactgcagcccatgtcctcattacgggtgagaatggtaccggcaagggcgttttagccgagtatatccatgcccgttctcctcgtagccggcagccgatgctgactgtggatatgggagctttgagcgagacgctgttcgagagcgaactgttcggccatgtgaaaggagcctttaccgatgccaaaagcgatcgcgccggcaagttcgagacggcgtccggcggcacgatcttcatggacgagattggcaatctgagccttgccttgcaagccaagttgttggctgtactacagcaaaaagtggtgacccgtgtgggcagcaatacaccgatccctgtggatgttcgtgtcatctctgccacgaatagcgatttgcccttct

SEQ ID NO: 726 - DNA (genomic), 1974 bp, PORYPHYROMONAS GINGIVALIS; double-stranded, circular
  misc_feature 1...1974
  hypothetical: NO
  anti-sense: UNKNOWN
gacaaggtagaaggacagctcaagggtatcactgacgagatggagcgtctgcgcaaagctcaggaggtatgccaagaactggccaaaaaagaaaatgcagacgagaaccaactctgcatcgtagagcctttctattccaacaacgaatacttcctcatcgtctacgatgtattcaaggacgttcgtatggtatttgctcctcccagctctgtaggtaagttcggaggcgatacggacaactggatgtggccgcgtcacacgggcgacttcagcgtattccgcgtgtatgccggtgccgacaaccggccggccgaatacagcaaggacaataaaccctataagcccgtttacttcgctgccgtatccatgcaaggctacaaggctgacgactatgccatgaccatcggtttcccgggcagtacggatcgctacctcacttcttggggtgtggaagatcgtatcgaaaacgagaacaatcctcgtatcgaagttcgcggtatcaagcaaggcatctggaaggaagccatgagcgcagatcaggctacccgtatcaaatatgccagcaagtatgctcagagtgctaactattggaagaattcgatcggtatgaaccgcggtctcgctcgtcttgacgtgataggtcgtaagcgtgccgaggaaagagcattcgcagactggatccgtaagaacggcaagagtgctgtctatggcgatgtattgtcttctctcgaaaaggcttataaggaaggagccaaggccaaccgtgagatgacttatttgagcgagacgctcttcggtggtaccgaggtggttcgttttgcacagtttgccaacgcattggctacaaatcctgatgctcatgccggtatcctcaaatcgcttgacgacaagtacaaagactacctcccctcgctcgaccgtaaggtgctgcccgccatgctcgatattgtacgccggcgtatccctgccgacaagctccccgatatattcaagaatgtaatcgacaagaaattcaaaggcgacacgaagaagtatgcagacttcgtattcgacaagagtgtggttccttatagcgacaagttccatgccatgctcaagtccatggacaaggaaaagtttgccaaggctatcgagaaagatccggcagtagagctttccaagagcgtaatagctgctgctcgcgctattcaggccgatgcgatggccaatgcctatgccattgagaagggcaagcgtcttttctttgccggtttgcgtgagatgtaccccggacgtgctctgccgagcgatgccaacttcaccatgcgtatgagctacggctccatcaagggatatgaaccgcaggacggtgcctggtacaactatcatacgacaggcaagggcgtattggagaagcaggattccttaagagcgatgagtttgccgtacaggagaatatcctcgacctcttccgcaccaaaaactatggtcgctatgccgagaacggtcagctccatatcgctttcctatcgaacaacgacatcacgggcggtaactccggtagccccgtattcgataagaacggccgtctgatcggtcttgctttcgatggcaactgggaagctatgagtggtgacatcgagttcgaacccgatctgcagcgcacaatcagcgtggacatccgctacgttctcttcatgattgacaaatggggtcagtgcccccgtctcatccaagagctgaagttgatctaatccattcgccctacaacaaacaaaaatccttgtgatcaatagagactgataagcctcctatcgacaaccaaggatataaggcacccacccggttcgatcacgaactcggtgggtgcctctgttttatcatctcccgaaacggccatcgaaagccaacggtctatatgcgaatcgttttcgttctctatatatttattggaatcgattttataaactgaaaatgattcataataaggagccg

SEQ ID NO: 727 - DNA (genomic), 3667 bp, PORYPHYROMONAS GINGIVALIS; double-stranded, circular
  misc_feature 1...3667
  hypothetical: NO
  anti-sense: UNKNOWN
cttatgggaatccctccgaatcatagttcccgaggagaaaagaacattactcattgccggggattaatacctgcgatttatagcgagtctgccggcattacaatcttcctctttaggatcttacatcacatgtcacgttgcagaaatttctgcatttgtggtttctaaaaacgtggcgcgtaaactttttcattttggcgcgagaagtaaaaaaatctcgagccaaaacgaaaaaaatcatgcgccactttattccataaaatcgaaccgaaatcaaagtgttttaggctcgtactccggagacagtagttcacaagcatacaggagaatagcattgatgtggaatcaaggtatctcaatattgagagcgttcgatcggtcaaaagaaacactctatcttccaaaattcaaatttacatcggtttattgctgctccttttgcaaagtggatttgacaaatcgtatggtgagcaaattgcttagatgaaaaaaaggataataggattagtctggttgcatttttttatttagttttgtggctgtccgtatcatagagcagttgtggaagtttcgtgacttgtgtctaaggccggtagcggctttttgagacttcccttgggttagggtaaaaccggagaagaaaagaaaacaacataacagtaataattttaagtttaacgcaaaagaaaagtctatgaaaagaatgacgctattcttcctttgcttgctgacgagcattgggtgggctatggcccagaatagaaccgtgaagggtacagttatctcctccgaggataatgagcccctgatcggcgcgaatgtcgtggttgtcggaaacaccactatcggtgctgcaaccgacttggatggcaacttcacgcttagcgtgcctgccaatgccaaaatgttgagagtgtcctattccggtatgactaccaaagaggtcgccatcgctaatgtgatgaagatcgtactggatccggactctaaggttctggagcaggtagttgtattgggttacggtacgggacagaaactcagcactgtttccggttctgtggccaaagtgtccagcgaaaagctcgcggaaaagcccgttgccaatatcatggatgccctccaaggtcaggtagccggtatgcaggttatgactacatccggtgaccctactgccgtcgcttctgtggagatccatggtacagggtcgttgggggcaagctctgcaccattgtatatcgtggatggtatgcaaacttctttggatgttgtggctacgatgaatccgaatgattttgaatctatgtccgttttgaaagatgcttctgcaacatctatttatggagctcgtgctgcaaacggagtcgttttcattcaaacgaagaaaggtaaaatgagcgagagaggtcgtattacctttaatgccagttacgggatttctcaaatcctgaatactaagccccttgataatatgatgactggagatgaattgctggattttcaggtgaaggcaggtttttgggggaacaatcaaaccgttcagaaggttaaagatatgatccttgccggagctgaagatttgtatggcaattatgattctttgaaagatgagtatggtaagacattgttcccagtggattttaatcatgatgcagactggctcaaggctttgtttaaaacagcacccaccagtcaaggtgatatttctttctccggagggtctcagggaacttcatattatgcctctataggctacttcgatcaggaaggtatggctcgtgaaccggcaaattttaagcgctatagtggccggctcaacttcgaaagtcgtatcaatgaatggctgaaagttggtgcaaatttgtctggtgcgatagcgaatagacgatctgccgactattttggaaagtattatatggggtcaggtactttcggtgtgttaacgatgcctcgttattataacccttttgatgtgaatggggatttagcagatgtctattacatgtatggagctaccagaccttctatgacagaaccgtacttcgcaaaaatgagaccgttcagttccgaatcacatcaggccaatgtaaatggtttcgcccagattactccgatcaaaggccttactttaaaggcacaggctggtgttgatattactaatactcgcacttcttctaagagaatgcccaataatccgtatgattctactcctcttggggaaagaagagaaagagcttatcgagatgttagcaagtcttttacaaatacggctgaatataagttttcaattgatgaaaaacatgatcttacagcattgatggggcatgaatatattgaatatgaaggggatgttattggggcatcttctaaaggatttgaaagtgataagttgatgttactgagccagggaaaaaccggaaatagtttgtctttgcctgaacacagagtcgctgaatatgcctatttgtctttctttagtcgttttaattacggttttgacaaatggatgtatatagatttctctgttcgtaatgaccaatcctctcgattcggatccaataatagaagcgcgtggttctattctgtcggtggaatgtttgacatatataataaattcattcaagaaagtaattggctcagtgatcttcgactgaaaatgagttatggtacaacgggtaactcggagattggtaattacaaccaccaagcactcgttactgtgaacaattatactgaagatgctatggggcttagcatttctacagcaggcaatcccgacctctcgtgggaaaagcagtctcagttcaacttcggtttggctgcaggggctttcaataatcgcttatctgcagaggtagatttctatgtccgcactacgaatgatatgtcgattgatgtcccgatgccttatatcagtggtttcttctcacagnatcagaatgtaggctctatgaaaaatacgggtgtagacctttctcttaaggggacgatctaccaaaataaggactggaatgtatatgcttctgcgaatttcaactacaatagacaggaaataacaaagcttttcttcggtctcaataagtacatgttgcctaataccggtactatatgggaaattgggtaccccaattcgttctatatggctgaatatgctgnaatcgacaaaaaaaccggtaagcagttgtggtatgttcctggtcaagtcgatgcggatggtaataaagttacaacaagccagtactcagctgacttggagacacgaattgataagtctgttactcctcctattacaggtggtttctccttaggtgcttcttggaaaggactttctttagatgctgattttgcctacatcgttggtaaatggatgatcaataatgaccgttactttacagagaatggaggtggattgatgcaattaaataaagataaaatgctattgaatgcctggacagaggataataaagaaacagatgttccaaaattgggacagtctcctcagtttgatacgcatttgttggagaatgcttctttcctgcgtttgaagaatctcaaactcacctatgtactccccaatagtctttttgctgggcagaatgtgattggtggagctcgtgtctatttgatggcgcgcaatctgttaactgttacgaagtataaaggctttgac

SEQ ID NO: 728 - DNA (genomic), 963 bp, PORYPHYROMONAS GINGIVALIS; double-stranded, circular
  misc_feature 1...963
  hypothetical: NO
  anti-sense: UNKNOWN
aattggagaatagtgctgcagcagcagtgaagcctttacggacagatcctatggaagggcagattcaattacaaaagaccaagcgcgaattcaaaggacacctgactttggtggttttcccttttgtcaagaagtctcgaaaaagtcccgaagcgactgccacggaaataggagaatggttgcttgcaaacgagtcggcagtatctgccatcgaagtggtaaagggctttctcaatctgaccattgctccgagggtatggttggagctgctgaacgagatccgagcggatatcaacttcggacataaggtcgctacagaggatagcccgctggtaatggtggagtattcttctccgaataccaataagccgttacaccttggacacgtacgtaacaacctattgggttatagtctttccgagatcatgaaagccaatggctatcgtgtggtgaagactaatatcgtaaatgaccgaggcattcatatctgtaagtccatgctcgcttggcaaaagtggggagatggtgtgacgccggagaaggccggtaagaaaggcgatcatctgatcggagacttctatgtccttttcgataagcactacaaagccgaactcaattcccttatggctgaaggtaagagcaaagaagaagccgaagccgcaagcaccctcatggctgaagctcgtgagatgctacgattgtgggaggcaggagacgaaaaggtcgtcgatctctggcgtactatgaatcagtgggtatacgacggattcgatgccacatacaagatgatgggtgtagacttcgacaagatatactatgaatccgagacctatctcgtcggcaaggaagaagtgctgaggggtttggaggaaggctttgtttgtcaagcattccgatggtttctgtatgggcggatcttgacaaaggatggcttggatgaaaaatgcttttgcgtgccgatgg

SEQ ID NO: 729 - DNA (genomic), 191 bp, PORYPHYROMONAS GINGIVALIS; double-stranded, circular
  misc_feature 1...191
  hypothetical: NO
  anti-sense: UNKNOWN
ggcgatgatttgtgccggaccggctttgaaaatctttagcactctgtccaactcatccggtgtcggtgtgagttcgcttgcaccgatggtgcgggcatctttgacttcgtcgatcatgaaattcagcaacttggcttgctgaaatcgtccgattcctacttgttcgatcatgtaagttttgacctatagac

SEQ ID NO: 730 - DNA (genomic), 2830 bp, PORYPHYROMONAS GINGIVALIS; double-stranded, circular
  misc_feature 1...2830
  hypothetical: NO
  anti-sense: UNKNOWN
ggtcatactccagtttcgaccgctgcggaaacccatataaggttttgaaggtcaggttggtccagtaaaagcagaattagaggcaatgcccgatacctcacgtagaataccattgctgaagccggctcccacactggtcagtacgacgagcatgaagataccccaaaatacaccgaaggctgtggccagactgcgtctgcgattgctgtagatcgtatgccagatctctatccaacgatctctatcgaaaaatctcatagtctcctttctcctccttcgtttagtttctcatcgcctccaccgcggggattcgtacggctttgcgggcgggttggtatcctgctatggcaccgcttactaccatgactatcagagctaatagggcagtgctcaggtcgatgctcggatcgcggaagagtgtcagcgttattccttctacctgtctgctcccgacaccggtggtctgtacccaatgcgatacgaactccatcagaccaacgccggccaccaagcctatcagtccggaaaacagtgtgaccactaccgcctctgtcagaatcatgttgatgatagctcttggcttggctcccagtgctttgcgaatgcctatttcgcgctgtctttcattgacggtcacttgcatgatattggccactccgataattccgatgacaagggtgctcaacccgataatccaaagaaaaacatccatgccattgaatatcttgtccatcatttttatgtccgtcaccggtgcatcgacatagggcacttccatatcggtaggatcatagcccttgcggaaggccagttggcgattgagtagtactttgagtctctccacgttctcctcagttcgcacagacgggcagttcatgaacagtgtgcagtccagactgaaccctttggcgaaaatacctgaataggtggcgaaaggaatatagttggggctgaattgcccctgttcgcctttgcaaacgcctacgacgaggaacgggatttgggacagatttacgtatttccctatgggcgaaatgctttccccgaataagacatcagccgtctgctcacataggactattacttttctcttcatggcatcgtctgatgtggagaggaaacgtccttcgatcagatgcgtcttgaccatattgccgtattctccggatacggctttcgtaggagtcgagtgtgtccgatcttcgtactgtacgtcgtagctccactggttggtatagtatgccgcacctttgatcagatcgggattgagcttgaccagatagtcgcagtcagcaggtgtcagctctatgtatctgtccttgggatagcctccgtactccttgctggtacgccatgtggagaagctgatcgcactcgtacccataccgaactgctccacattgtgccggatgccatgctggaatccgcggccggcactcagcagcagtattagcagcagtacaccccaggctacggcaaagccggtgagagccgtacgcagcatattcttgcgcagggtggctcctaattcgtgcaaattgtctaagtcgaacataccgtctatcgctcttttcaggtctaaggccccgatgatgccgtctttgatatggataatccgatccgtactgtcggctaccgactgttcgtgcgtgacgatcaccatagtgatcccatcgcgattgacactgcgcagcagctccatcacctctactgtcgtaacgctgtcgagtgctcccgtaggttcgtccgccagaatgacctgtggcttggcagccaaagcgcgagctatggcaacgcgctgtttctgtccacccgaaagttcgttgggtaggtgatcagcccaatcttccagccccacccgtcggaggtattccatggccatctcattgcgtttgcggcgactcatgccctgatagtaaaggggtagggcaacgttctccactgcatttttgaatgagatcagattgaagctttggaacacgaatccgatcagtctgcctcgtatctccgccgctcggttctcggagagattgcggatgagttcgccgtgcaggcgatactcgccctcgtcgtaggtgtcgagtacaccgaggatgttcagcagcgtactcttgcccgatccagatgctcccatgatagagaccatctcccctttggcgatgtgcagatctatacccttgagcacgtgtagaggttgtgctcccggataagttttgtggatgcctttgatgtcgatcattttattgcgattgttcttttattgtttgtctctcttctccttgcgcatgatgatggaaggaatcagaagtccgagaccgccaaaaatcagcagacagattcccgaaagggtttcgaatgtgtggccgaagctccagccgtcaagattttctattacacgttggaaaacaaatgtcagaaagaaagccagcagcagtccgatgcccatgcctaccatcatgaaacctactttgatgccgagcccttgattgtctcgggtgctaaaggaggaagttaactgtgttaagtctgcatttctttcgggagaaggcaaggagtcgagcttctcgatcaggcgaagtcgttcgcctcggcgtacgtagagttcgaaaatcttaaagatgaagtagaacactaccgcaggtaccaaaacagattctaagttcataatcgtttctttttagtttgagggttattacttgggtttgtttgcctctttgacggatagtgctcgaaaaggttacacctctgtatcgttggttaccctcttcaagagaggtcgctaccgtcgatcctgcttcgttgtctttttcgtttctcttgctttctttcc

SEQ ID NO: 731 - DNA (genomic), 2144 bp, PORYPHYROMONAS GINGIVALIS; double-stranded, circular
  misc_feature 1...2144
  hypothetical: NO
  anti-sense: UNKNOWN
aggaaatagaagttcccttcatagcagagagcccttattcgttaatgacgtcacaattggagggtaaagaaacctattttggctcttctgatggttctaaaagattgcattatacattgtgcggtttttctgattttaatagatatgtcctcgggtctaattcttctagttcgagtcgtgtattcttcgagattaaaggaggggaatatcaacccgttcaattgcagcatattagaggtgtaatagcaggcattatattgaatgaatatggctgggatgatgaacttggaaaattggacgaaggggtatacagtacatcaagacatgataacaaaacggagcgttttggtaaaaaatatctttggatggccttgtataaaacagatgcaatactttctgattattgttcgattttgaaaggtagatattatggttatgctatacccaaacaagaggatatggcatcgaacccttatccatggttgacagacgaatattccacaatagatccatcactattgggtagacaaggaaaagattttatttcttttgaaatcaatctattagaggaagttaataatgttgataatgagcaatggatggatagagggtatcaattaccagctccgcggttgctcttgaaagacaaggataatgcagactgggtgctgctaacgagctatgatgggcataaaacagaagcagcagatggtaccatcaaagatctcttcttgtataccaatggtgctttcattaagaaagaagagttgagtgcttacaagaaatgggctaaagaacagaacttctatgggcgatggatgcctgaatgcctaaatggaagcacggattatttgtggaatgaatacccttgggcagagacctacattcgacaacgagatgaatgggaaaagaatcatagctacgaaggtgtaggttttaaattgcagttgtcatatgagtctcaattgcaggaaaatagcttggttttgatgattctaatgaatggttgcccgaagtatgcatgcccaaccatcacattatggaagacttaaagttatacacagccgaaagaggtgtagtaagagatatatccaccaatgaaatcgtttcggtaaatattcgggttgaagcttaaaggggttagctatgcgaaaagactatttgtcagaatatctttcacattctagatgtgttcttgtctattattctttaggagaaaaattaatgagagcaaaaaatcatcaaggtttaggaaagatttatgacttatcaggttcatatgcatatgaagatagatctattctggcaatagagcctatgcacatctccaacgtctcgtgagatttcttgttgagaggtcaggaattgcttactgagaagctctttggtgcataatcatattttttgtccatcgtctattcacgacttcggagtgattgatccccctttgggggcaagggtctttgtggtacaaatggcaatttgtggtacaaagacacaccttgccagtgtcaagaagggatgcttcattgcctctaccgatcactctgtttctttagcgctcgagcaaacttaagctcgagacctcgattaattaatttctcgagatctcgaggtctcgaggtctcgacattggcctcttctaattgcggagctgagagtgttgatttatcgacgcagtcctcgcttgtgcggagtgaggatcttcttcctttgctccgctagagtgagatactcgttgatgtctttatagggagcgtagcacgctcgcatatccttgacgggtagcccagcgtcgatgagttgtttcgttgctcgatcccccgcttcatcattatcaagaaggctctcaatcatagggtagggatgaagtgtgggcatgagtttcggaagtagggtgagcgaattaagtatgatgctttcagcttgcccctcggggtgaagtttcctccaagagagaaagtccatgaagccctcgaagagcaggagcttgtgactatcagtccctttgattgtcgttatggccttgggtgcaaaacagcccttaaagtagggattgcgtagctcccatccttcagcatcattggggaagcccagggcaaagaaacacttcctagagactttgtaatagacttccgataaga

SEQ ID NO: 732 - DNA (genomic), 810 bp, PORYPHYROMONAS GINGIVALIS; double-stranded, circular
  misc_feature 1...810
  hypothetical: NO
  anti-sense: UNKNOWN
cgacaaagaattaagaaggcgattgactacaaagttgattgccttttttattgatgactggctcaggcgtcaaatcacgaaagcaaaagaggctgtccccatagagtcagggggcagcctcttcaggatcagtatattttgtgtctctgattattcgggacgagagcaacggctatagaatgtgagttcttccggacggaaagcgcgcacgtagctgtcgatcttctcctgctcagcctgaccgtaacgtagatatacctctgccgactgacggaatgaatcgtcgtcattggcagccaacatcagcagatggccgaagactgcatgagcagtcatctctacaagccgacgtgcttggaaatcgagcagctcctggtctttctgttctgttacgaatgctatcagtgcttcggcacggtcggtcatacgagccagagcctctttcatcggttgcaactctggcttaacttctgtctgctggtactcttcacggatacgagcgatataagtgcctgtcgtgatatggcgaatggctgctacgacctgcaactgtgtggtaccttcgtagatgtttgtgatacgtacatcgcggtagagacgttcgcaggtgtagtccttcatgaagccgctaccaccgtggatctgaacacagtcatagacattctgattggcaaactcggaggtcattcctttgcccataggggtataggcatctgccagacggctgaaatgcttcattttccgcacgttcttcggaagtcaatttgcgctcgtggctgatatcctccagcactttgtacatatcgacaa

SEQ ID NO: 733 - DNA (genomic), 560 bp, PORYPHYROMONAS GINGIVALIS; double-stranded, circular
  misc_feature 1...560
  hypothetical: NO
  anti-sense: UNKNOWN
ggcgaaatagatgcggagcttatcgccgatcttgagatgaagtttgtcggcagtaacttgtggcagaagaataggattgggtaccgtatcggcagaactaaagctcggataatttcccgaaacggtttgaccgaagagcggattgcgagttcggagtgaattgtcccccatcagtagaataccggcaaaagcactgtctgtcttggcaacacctgtcatttcgatcgtgggcactacccggtccacaccttcgacagaggttatagcttcaagcatcccgaccggagcattgaaatgatctgaagttccggccacgggggcaatgcatagatgtcccgtatagccgtataccagactgcggatattttgtttgaagccaccagctatcgacacggtaatgagcatgaccatcaagctgagcatgataccgatcacagagagacgaacaataggggctattcctttcccctctttccctccgcccctaaagagccgtccggccaaaaagaaatcgatcttcatcggccctctaccctattcttctatcagacggagaaaat

SEQ ID NO: 734 - DNA (genomic), 406 bp, PORYPHYROMONAS GINGIVALIS; double-stranded, circular
  misc_feature 1...406
  hypothetical: NO
  anti-sense: UNKNOWN
cataagagcaaaaacgattcgtcaattttcctcaacccaaacatctcattcggggaacggattcggggatcaaaaaaagaaaaccatggcatctcgactcacttcctgccacaagagaaaaatcaagggggagccgcaaatgaaatactcgcgactcccccttacttggtttgagagaaatatcagatactgaaagctactgtatggaagaacaacagtcctatagtcgcaatagcatcatcttcttcacattattagttgactacaactttccttacattgctactcgtggcaggactttgcagactgacaacgtagactccatcgaccaatggttccgtcatagacttacttccgggttttacgtccaatcgaatcagaagttttccgtcagttggataaacat

SEQ ID NO: 735 - DNA (genomic), 788 bp, PORYPHYROMONAS GINGIVALIS; double-stranded, circular
  misc_feature 1...788
  hypothetical: NO
  anti-sense: UNKNOWN
gaatttgtgggcctaagaaccgcaatcattttcataagaaatacctccgtcctttattagaccaggaaaagatcgaaatgaccattcctgaaaagccccaaagtaagaaccagaagtatcgaacgaaggaaacaatcaaatgatatcatctcccaaaaggtttttcaaaccctcgaaagaggaaataatataatcggtgcaggggttggaaaggtattcctttctgaccatcaggacggttgtaaatcccagttcccgtcctgcttttatttcggaagcgggatcatcgcctgccacataggcttttcggtctattaagttcggttctctatgctgactgtgataaagattatccggacaaaatagagttctatcctcctgtagaatgtataaaggattgggagaacgactaggctgctttgcaggaatcttttatttacggaaacaaaatttctttcggacaacttttgcttcgcattaaagaattacagcagcgattccgaagtatcggcacaacgggcaagtagaaagtttttgcaaaatattctacttcctaagggcgtaatcgttttccatattatctctcaaaaggtctctcaagccctcgaaagaggaaataatataatcggtgtaggagttggaaaggtattcctttctgaccatcaggacngttgtaaatcccaattcccgtcctgcttttatttcggaagccgggatcatcgcctaccacatacgtctttcggtcttttaggtccaattccctgcttaattcacggaagatatccagt

SEQ ID NO: 736 - DNA (genomic), 2295 bp, PORYPHYROMONAS GINGIVALIS; double-stranded, circular
  misc_feature 1...2295
  hypothetical: NO
  anti-sense: UNKNOWN
cctctgcttcccgtacagccgtatgtgccaaaagcgagaagcctgtaatatcacctgcagcatagacattgggcagggaagtttgcatcctctcattagtctttacacctttgccggcaagcaccaatccgagcgactcgaatccttgcagcacggggcgacgtcccacactcatcaggatacgttctccttcgatctctttgctttctccttcgtattctaccgtaacagctccgttgcgaaccgatgttactttgtgcccgaggtagaatttgattccttctttttcatagtgagcgcgtagcatagctgcatgttcgggatcgataccgttgagtatttccggcagcatctccaccacgtgcacttgcgtaccgataccgttgaagaaagaagcgaactccattccgatcactccaccaccgatgatgacgagagaggtcggaatctctttgttctgtagagcttcacggtttgtccaatactctgtctgctccactccggggatgggtggaataaacgtctccgaaccggtacatagtagcaggttggcagctttgtactgtgcttcgcccgcagtaatgccgatgatgccgtctgcatcgcatcccgttacggtagcttctgccgtcaccatctctactccggcctctgtcaggcgtgaacggatgcctgcagtcagcttgcgaatgattttaccttttctggcaatcaccttgccgaggtcaagtccatcggccgttccacttactgcatatttagatgccgtagcaatttgatgtagcactttggccgagtagagtagcgtcttggtcggtatacatccttcgttgaggcatacaccaccgagagcattcttctcaattaggagggttttcaggccacctttggcagcacgttcggcagccgtataaccggccggccctccaccgatgatagctaagtcgtagcgcatagttttatagattgttgcgttcgatatccttaaagtagttgtacgtgcccactttcagctccacacaggcagcttcgtcacagacaatgatactctgacgatggagctgcaaggctgtgatcgtccacatttggctgactgcaccttccacagcttcacgaagagcacgggctttagtatgtccgttcacgaggatcattacttcccgtgcatccataattgttcctactcctacggtgagagcacgtttcggaacctgattcgtatcgttgtcgaaaaagcgactgttagccagtacggtatctgtagttagcgtcttgatacgggtgcgagaggtaagagaagaccccggctcattgaatgcgatatgtccgtcaggtcctatcccgccgatgaaaaggtctatgcctccggcagcttcaatagctctctcgtatgcatcgcactcggccgtcaggtcaggagcattgccattgagaatgtggatgttctgaggcaggatgtcgatatggtcgaacaaatgccgatgcatgaatgaatgatagctctccggatgctctatagcaaggcctacgtattcatccatgttgaaggtgattacgtggcggaaagatatgcatccttctttgcatgctttcactaactctctgtacattcctatcggcgaagaacctgtcggtagaccgagtacaaacggtttttcggccgtaggagctgctttatggatacgctcgatgacgtagtcggctgcccatttggagagcttgtcgtaatccggctctatgattaatctcattgtaagattggggttagtccagtagtggatatgatatattactgacgatcggctttcagacgttcggctattttattgccaagctcccaacccttctcgtacaggtcatccgtggtagacatcttttgttccaaaggttcgcctaccatttcccaacccatttcttctgcaaaaggaactatctttttcacagcctgaccggcccatgtaaaggagccgaacacgctcagatagcgatcttttacctcgcgaagacggatcatttccatgatattcttgatcggtgaaaagatctcattgctgtatgtggggctaccgattatcactgccttgtacttaaagatgtctgcgcaggatgttagatgccggactgaatgctacattgtggcatacaacgttgcggatgcctnctgcagcaatgccctgtgcgatcgtatctgccaatacttncgtattgccgtacatagtgccgtagagaatcactgcaccttcttcggcttcgtatcggctcatccgatcgtagaggtcgaaggcttcagagaag

SEQ ID NO: 737 - DNA (genomic), 1270 bp, PORYPHYROMONAS GINGIVALIS; double-stranded, circular
  misc_feature 1...1270
  hypothetical: NO
  anti-sense: UNKNOWN
acgtttttaggagcatgaaacaaaaaatttcacgaacgtaaatgggacggatcgaagttttacttcggtctcgtttttcatctctattcgcctatgaaagtcctaaggctctcttttagacaaaaaatctttggccaaaatccttctatcgggagcatcgaggaaatgaagttgcagtcctcggtcatatacctaatgatataggggagtggatcggatcggtttgctccctctcgaagagaggtttctgtcccgtttcggtctgccttatgagaattattcgaagcagtcgttggcgggtttaaggtgtttcatatacctttgcgctgcaatgcaatcataaagactgttttctccatgttggaaaagctcattattctggatttcggttctcaaaccacacagctcatcgccagacgaattcgcgagctgaacacctactgcgaggtttatccctacaacaaactgccggaagacctctcaggagtgcgaggcatcatcctgtcggggagcccttattccgtgtatgacagcaaggcctttcgtatcgaactgagcgaattacggggcaagttgcctctcttgggtatctgctacggtgcacagagccttgtccatcaagccggtggcaaagtagagccgtgcgacagtcgcgaatacgggcgaacacatctgaccctccggcagcctgatgatgcactgctgacaggcctgcaatccggcactacggtatggatgtcccacggcgataccattacgtcattgcctgaaggattcgaggtcatagcaggtaccgaggatgtacccaatgcagcatttcgcatccgaggggagaaaacgtggggcgtacagttccatcccgagatctaccactcggaagaaggtaccaaactgcttggcaacttcctcgatatatgcggtatgaagcgtgattggactccggcttctttcatcgaagcgactgtgcaggaacttcgcgaacgcttaggtgatgacaaggtgatcctggcactctccggaggtgtggacagttcggtggtggcggtgcttctgaacaaagctatcggccgcaacctgacttgtatattcgtcgatcacggcttgctgcgtaagggcgaattcgagcgcgtacttcaggactacgagcacttgggtctcaatgtaatcggggtgaatgcaaaagaaaaattcttcgcagcccttagcggcgttaccgatcccgagcaaaaacggaagattatcggtcgcggcttcatcgaagtgttcgacg

SEQ ID NO: 738 - DNA (genomic), 1064 bp, PORYPHYROMONAS GINGIVALIS; double-stranded, circular
  misc_feature 1...1064
  hypothetical: NO
  anti-sense: UNKNOWN
gccgaaggattcgacgggctgatcctccctgcggaaaatgcacgtgaagcagccgtcgtgaacaacctcaatgtctatggcgtgaagcatattgcagaagtgatcagccatttcaatgggggcgatcagctacagcccactatagtcgatacgcgcagggaatttttcgaccatcagcagcaggtgtctttcgacttttcggaggtgaaggggcaggagaaggtcaagcgcgccctcgaagtggcggccgcaggcggacacaatctgatcatggtcgggagtcccggcagtgggaaatccatgatggctaagcgaatgcccggaattcttcctccgtttacacttagcgaatcgctcgaaacgaccaagatatactccgtggccggtaagctgggagtcaattcgatgctcctgacccaacgccctttccgctcgccccaccattccatctcttccgcggcactcgtgggtggcggcacttatccacagcccggagagatcaagtctggcgcacaatggcgtgctctttttggacgagctggccgagttcaaccgctccgttctcgaggtgatgcggcagcctttggaagatcggcagatcaccgttttcgagagccagaatgacggtggattatcctgccggattcatgctcgtggctgccattgaatccctgtccttgcggctactacaaccatcccacacgcccttgcacctgcgcgcccggacaggtggagaaatatctcagccgcatatcggggcctcttctggacaggatcgatatacaggtagagattacgcctgttccttttgagaaaatatccgatagccggccggccgaaagcagcgagaaaatccgccagcgagtggttgcagcacgcgaaatccaaagcaaacgatttgccgactactccggtgtccattgcaatgcccagatggacgacaaattgatgaaccgctatgcactgcccgacgaaaagggacttcaacgattgaggacggctatggaacgcttcgacctctctgcacgtgcctatggccgtatcttgaaggtggctcgtaccat

SEQ ID NO: 739 - DNA (genomic), 535 bp, PORYPHYROMONAS GINGIVALIS; double-stranded, circular
  misc_feature 1...535
  hypothetical: NO
  anti-sense: UNKNOWN
ggactatgcgcacacgccggatgcactgatcaatgtattggataccatacgaccactggcaaaatcgcacaaggtgatcacagtggtaggagcaggaggcaatcgggacaaaggcaaacgtccgatcatggcaaaggaggcagcccgcagaagcgaacgtttgatcctgacatcggacaatccgcgtgatgaagagcctcaagaaataatccaagaaatggctatcggactttcgacagaagacaggaagaaaacactgctcattactgatcgggcggaagccatccgcacggcctgcatgctggcagagaagggagactttgttttgatagccggcaaaggtcatgaaacttatcaggaaatcagaggtgtcaagcaccattttgatgatcgcgaagtggtctgcgatgccatgtcgaaagatcgtatcgttcaataaactctatagatcccatgttgtactatctgtttgattatctcgaaaagctacagctccccggagcgcgactggtccatacgtgtcatttcggtcggt

SEQ ID NO: 740 - DNA (genomic), 550 bp, PORYPHYROMONAS GINGIVALIS; double-stranded, circular
  misc_feature 1...550
  hypothetical: NO
  anti-sense: UNKNOWN
gcaccggcgacgatgacgcccgagcaggctccgatggattggatgatcacattctgccccagcatatttcggcgtcccgaaatggtgccgatacctacggccaggatggcaatgggaatggcggcttcgaatacttgcccgaccttcagccccagataagctgcggcagcagagaaaataactgtcatcaccaaacccagcaggacagaataggaggtaatctcgcgcggcgtactgccggcaggcatcaccggttcgtactcttcgcccggcttcagctcccgatatgcattttcgggtagcttgctcgttgtctgtttgttttccatataatatatgtgtttgattggatcgttttttgcaccgccctccgatcgcaataagagggcggagaatcgtactgaaacaaagcgctcaaatatatacaacttcgttgaaaaccggtcctttcgatcggacaggaagcccgatcattcccggcagtatatccgtgcgatgcgcttcggagtcgatagactacagaccgccgctttcgccgccgccttgctcg

SEQ ID NO: 741 - DNA (genomic), 639 bp, PORYPHYROMONAS GINGIVALIS; double-stranded, circular
  misc_feature 1...639
  hypothetical: NO
  anti-sense: UNKNOWN
cagtgtttgaattgactctgatatgccgaaaaatacgaaaaaagtcgaaaagaatcaatatcctccgacaatcaacgtgaatacaacaatcaaaagtaacacagactcttctttatctctaatccctgagatccagaaagaacgcttgtaatggcaggtcttctgacttattcaaggcttcgctgccttcccatacgattctgtatagtggctttctcgtggcaaaacccttacatctgaacttacagctgagggtacagtcccagaatttcactgggttcccttttcattctacactccatgaaccggtgtagaaaaccattgacacggcaaagatattcattatatctatactagtgcggaaaattgaagaaaaaaatatggatttgtttgaggatatctttcagtatacgtcattaaggctaatcgggtgtgaaatgccgctgatactttatgtgttcgtgtgtaaataaaaactgaggctgtctcgtcatgagacagcctcagcttcatttattggtaggaatatttgggatattccgctgcagtcattactacaatccgattccaagcgttctcttcatagatttgctctgatgagcccttccttcaatggtatgcgatccgcagaacaccata

SEQ ID NO: 742 - DNA (genomic), 987 bp, PORYPHYROMONAS GINGIVALIS; double-stranded, circular
  misc_feature 1...987
  hypothetical: NO
  anti-sense: UNKNOWN
ggcttatgctcatttatagtatagtgcatgcaactctctgaacaaaagggattgaaataggaatcaggagtacttttgacagataagcccaagtatgcaatgggatgatcaagtctcgatcaacaataaatcagtgtaagcatgctgtcaggattcagcacttcggccgcaatctcacggagccgatcggaggtaatggcatcgatacgatggaaaatatccgaaaggggatcgtatttgccatagaggagcatactcttgcccaatgaaaggaatgtggactccttattgtcagccgacacgatgagctgtcctttgaactgtcgcttggcagattccagttctatcggagaaagagggtgttcgatcaaatagcgcaactcttttctgacaagctccatggctgcttccgcatatcggggagcgcagccgaggtagatattgaagactcccgtatcggaatagggcgtgtaattgctctctacgttatagacatagccatgctcttcacgcagtgagagattgagccgggagttcatacccggccctccgaggatattattaagcagacttagcggaatgcgtctgtcgtcgtggagcgaatacgccggaccgcccatgaggatgtgatgctggtaggtatccttgtgccgtctgatggtacgcggcagaaagccttctctgagggtatggagaggagtaccatcggtattacggatggagaccttctcggccggattaaggggccaatcggacaggtctgcttctccggccaggaagaagatcatattgtccggccggtagtggcgacggaggaagttacgacctatttgtcccgtgatgcgtgatacagaagcctctgtgccgagaatgttatgtccgagaggatgatgaccggaaaaggatattctcgaattcgtcgaatataagttccgagggattggtcttcgataagaaatcgattttcgtcgaataacaaccggtttt

SEQ ID NO: 743 - DNA (genomic), 1526 bp, PORYPHYROMONAS GINGIVALIS; double-stranded, circular
  misc_feature 1...1526
  hypothetical: NO
  anti-sense: UNKNOWN
tcggcattttcggttcgaaaatccaagtttccaaccaanccacagacttcgatcgctcccctttgcatagcaaatctgtgactgccggttcatccggaagcaggaaacttttttcttgttatcgttcaagaacgnaaagtctgtgccgagcgattggcacaagtccttcccggcctgttagagattgaggactgtcagccaatcggactttcgcatcggtcattatgacagacgaggaagtattgaacacccgccaaacggtcattgttatgcttaaagggataaatccgaatcgtgcggcacgataattgcaatacgtagttagagatggcatacgactttacacaaacattccgcaacagcctggagtacagctatcaggaagcaacccgtctcggcgtcgtagccgtgacgcaagatatgctcgtactcggtatcattcgcgacggagacaatggcgcgatcgacatcatgcggcactatgggatcaacttgtacgaactcaaacggttgatcgagttggaagccatcgccgagagtttgcctgcttcgcctgagggatcgcccatcttcaccccttcggctcgggaggctatcgatgatgccacagacatctgtgccgacatggaggacgaggccgtcagcccggtccatctgttgctgagtatcctcaactcgacacaggagagcttagtacaaaagatatttatgaaacaaggtataaaatacgacaccatcctgtcggattacttcggacagcgcaacccctccgaagggaagtctccctccgaaatggagatcctcgacgggtaccaagacaacgacttcgacgacgaagaggacgaatcctctccgccttccgggaatagcgggacaggcggaggctccggcgacgcccccgaacagaataccggcggaggcgatactaccaccacgacacggagtggaggcgacacgcctgcactggacaccttcggcaccgacatcactgccatggcggcagcaggcaagctcgacccggtagtgggtcgggagcaggagatcgaaagggtgatacagatactcagccggcgcaaaaagaacaatccggtgctcatcggcgaacccggtgtaggcaagagtgccatcgtggaaggactggccgaacgcatcgtgaacaggaaggtgagccgtattcttttcgacaagcggatcatcagcctcgatttggctcagatggtagccggcaccaaatatcgcggacagttcgaagagcggttgaaagccgtgctcgatgagctgaagaagaatccgcagatcatcctcttcatcgacgagatacataccatcgtgggagcaggctctgcagccggatcgatggatacggccaatatgctcaaacccgctcttgcccgtggacaggtacagtgcatcggagccactacgctggatgagtatcgtaagaacatagaaaaggacggagcactcgaacgccgcttccagaaggtgccgatagccccctcgactgcagaagaaacgctgaccat

SEQ ID NO: 744 - DNA (genomic), 638 bp, PORYPHYROMONAS GINGIVALIS; double-stranded, circular
  misc_feature 1...638
  hypothetical: NO
  anti-sense: UNKNOWN
tcagctggcagctcacccttttcgtcttcatcctcctaccgatagccggagggctgatgggtaaggtgggcaaaactctcaagcgcaagagtctggaagggcagaatcagtggggaagcctgatgagccagatagaagaaacgcttggcggcctgcgtatcatcaaggcattcaatgccgagaaaaagatgcaggatcggttccatcgtgccaacgagcagtttcgccgtacgacgatgaaggtcttccgccgccagcagttggcacatccgatgagcgaatttctcggcacagctaccatagccatcgtactgtggtatgggggtacccttatcctgaacaatacgagcgagatcgatgcttccacctttatatattatctggtgatcttctacagtctgatcaatccggtcaaggagctgagcaaggcatcctacgccattgaaaaggggttggcctccatgtcgcgcgtggacaagatcctgatggccgagaacgacatcaaagatcccgaacagccccaccccgtggtgttcgaagaggaggtcgtttacgaccatgtgtggttccgctacggcgaagactgggtgctgcgcgatgtctgtctgacaatcccgaaggcaagacggtggcattgg

SEQ ID NO: 745 - DNA (genomic), 2515 bp, PORYPHYROMONAS GINGIVALIS; double-stranded, circular
  misc_feature 1...2515
  hypothetical: NO
  anti-sense: UNKNOWN
acttgatttcgtatgcaatgatcgtaaagagtttattacgttttgtcttacaggtgctaacgtggatgncagaaacccgaaggtttggcaggttccggctaaagaactatacggaaaactctttgcagataagggatattctcgcctaaactctttgaaagcctctttgatgacggcatccatcttgtaaccggaatcaaggcaaatatgaagaacaaacttatgccctcgtgtgacagaatcatgttgagaaaagatacatcatagaatgcatcaatgatatgctgaaaaacaccggcaaacttgtacactcaagacatcgatcaatcaataacttcatcatgaatccggtctcagctatagtggcatactgtttttacgacaataaacctgaaatcatttttggaaagagcacccataaggcagcacaataaatatctccttagctatagattaggttcgtgttctttgaagtaacctactatcaaccacttatccaaaggggaaacccaatgggagtgtagcatgtcagtaaaggcataagtccactaattgccaagtggcgactgaatgacgaggtagaaagacaagcacaaggatgaagcctgaattggttgaacgatagtccagaggctgttaaatgagccgtgacgggaggcaattacaaacgccactccgtagtactttccggtgtagtctgacggattgaacaaaaggtcgaacgtcgcatccgacagtttgtcgcactaatagattatgcaagctaaatggggattgcctaagtcgaggagcctaaaggctatgaggtatagcctctgaaaacccgatatggcaacggagctcccgtagtaatccgaggaggatagcatcctgtacatggcgaagatgaacagttggaaactttatattgaaaagcatgtaatctcactctatgtcaaacaaatgagcgtttcagatatatcagatatagaagataagttttgtgatatatacgaaataagcctttctacgagtgccatatccattattactaataaagtaatccaatctgcccttgaatggcaaaattctcctcttgacaggcgttatatggttgtctagattcaaagtaagagaatcaggcaagataatcaagaaaacggtttatctatgcgtaggacttaacgacagggctataaggaagttcttgggatgtggataggccaaggcgagagttcttcgttttggatgggcatattgaccgatttaaaggctcgtggtgttgaggatgtgctcattacaataacggataatctcaatgacttcacatacatcattaaaacggttttccccattccaccaccagatatgtgttgtgcatcagatacgcaattcctgcaagtatgtggttttggaaggatatgaaggatgttacggctgacatgagggaaatatatacttccgtaaaccgagaacaagcggtatcggcattatctcacttcgagcaaaatggggttcaaagtatagacatgcggtacagagttggcatcgtaattaggacgatttaatggctttctttgatttctctgtagagatgaacgatttttacacgatcaatctgattgaaaatctcaatgggaaaattcgcaaatacatgaaaaaaagatgtcgctccctacagatgatgctcttcgcaagtctgtttggttagctctgcaagagatagaaaagaagtggacaatgccgataaaaaaaaaccgggattgggctatgaatcaatttattgctatatttgaaaatagaatcgagatttagtcgagtgctaaatctcaacccaaattatcgtttacacaaaataatggacagttccttttcgactactcatatcgctaccttttactcctttgagtgaaaaattcttctaccagatgttcacacttatcctttgcatcttcaatatcttgaaattcaactaccttaaaattgtttcttttacagcactcgataattccataatgtatttcattaattcgttttttttcatcttctgtttttttagagacttcctcacgggtagtcttcattttcaaatccagccgatcatttatatcccttttgttgtctaatcctattataagacaatcttgtttgtttatatttctcaaaaaatcttctgtgagatgcattccctcaataataattttctctctcctgcttcgataaatctccagcatctgttcaatcatattcgaaacattatttttttgaatatttaattcactatcatccattctatacgtggatgtttgataagtttttctatctctagtgctaatacgaaaaaaattccgaaccatatcagtggaaagcacccctgaaaattgatatttatttgatagatgattggatattatagatttaccagtaaaagagcctccaactacaactataacacaaggtcttgtatatgatgtgaaggcatctattgattttttttcccataaatccctaaaatgtttctcaaaagcccatccta

SEQ ID NO: 746 - DNA (genomic), 2575 bp, PORYPHYROMONAS GINGIVALIS; double-stranded, circular
  misc_feature 1...2575
  hypothetical: NO
  anti-sense: UNKNOWN
tcatctcccgaaggatagacgtagctgatcatcacatgcagcgatggcgtatctatgtctgcccgcagagggatgtagcgttcgagataggccgaatcgaaagagacagacttcgattcggcagctttgttattgctacagcccaaagcagtgatcaaagacaatggaaagagtagcaacagcacgctgcgcatggatttcatcatagtgaaagattgtaatcccgatagattcattttactgccacaaatttacgcaattcattcggataagccttttttttacgcgccggtgcacattctacgagcctgttcgaagttattagagtatcgaaaattgcttgcattttgatttgaatctagtacgtaaaaacaactctgctcagaatcttaacatattgccatgcaaaagagggcctctgtgaagaaatgcttctttaaggctgttttcaatattgagcaccttaagatgttactcgaattctgatgaggtggatctcttcaaacggtcaaatctgttcatgtggcggatgaactattatctttggcacgacggagccggtctttccatcatcgaatgaggtgagctcggcatttcccgtttgtgttaaagtcttaatcaaagacttatttgtgttcgatatgcagagagaaaaagatagccttatcgttgtatccggcggaatggacagcgttacgctgatgtacgagaagagagcctccatcgctttggctctcagttttgactatggttccaagcataatgcccgtgaattgtcttttgcgcgtctccatgcagagcgtttgggtgtggagcatctgattatccccctcgattttatcgggcagtattttcagagtgatttgttgcttagtggaggagatattccggagggccgatacgacgaggaaaatatgaagagtacggtagtgccctttcgtaacggcatcatgctggcggtagctgcggggttagccgagagcaggggattgaggcggatttatatcgccaatcacttcggcgaccatgccatataccccgattgtcgtgcctcatttattcgtccgatgaccgaagctgttcggtgcggtaccacgaacggcgtgctcatagaagcaccttatactgatattactaagacagatattgcacggataggagcttcattgggtatagactatgccgagacttggagttgctacaaggggggggtgtttcattgtggcgtttgtggtacctgtgtagagcgcagggaggctttgcacgatgccggcattccggatgccaccgagtacgaaggttgagtatacttcattcggcacgaagttatcaggcgcgatgaagaaaatagggctgctatccgatacgcatggctatatcgacgaaaagtaccggatacatttcgccgattgcgatgagatttggcatgccggtgacatcggctctgtaacggtagcggactatttgtcgggtttggctccgctgcgtgctgtctatggcaatatagacgggcaagacattcgtctgcagtatcccgaagttctgcgcttttgtgtggaagaggtgaaagtgtttatgacgcatatcgggggataccccggtcggtacgaacctcgtatatatcgaatgctcgtgcagaacccacctcgtctttttgtctgtgggcatagtcatattctcaaagctatgtacgataagaagttggatatgctgcatctgaatcccggagctgcaggtaagtatggttttcatgctgttcgtactctgatgcgcttcgtgatcgatgggcgagatatacgggatttacaggtgatagaattggccgatcgatagaatattaaagatgaaacatttcattctcaaagcttgcattttcttctccctgctgttaggcggatggatatcctcttcgtgtcgtggtggagcaaccccttcttctaccagtggggattcagctcctgctaggatcgatacgctggaaattaaattgctcttcgccggagatatcatgacgcatggccctcagatagaaagtgcaaagtgcgaaggtgggcgcgtgtacgacttttcctcctcttttgatactttggcatcaagaataggggctgccgatcttgccatcggcaatctggagaccacctttgcaggagccccctacagcggataccccaccttctcttctcctgacgctatgggtgaggctcttaaaaatgccggtttcgatgtgctgactactgccaacaatcatactgccgataagggaaaaaaggggattatacgtactctcgatatgctggatagtctgggtatagcccatacaggcagctatcgagatattttcgatcgggataaaatgactcctcttatccttgaagtaaaaggtgtacgcatagccatactggcctatacttatggtacaaatggaatgcctgtaccggctcctacctgggtggatcctatcgatacggtcatgataaagaaggatttgctgcgagcggattccttaggtgcggactaccgcatcgttcagattcattggggaatagaatacagaaaggagccggggccgagtccc

SEQ ID NO: 747 - DNA (genomic), 2609 bp, PORYPHYROMONAS GINGIVALIS; double-stranded, circular
  misc_feature 1...2609
  hypothetical: NO
  anti-sense: UNKNOWN
tggcccccaaggtaggaanccgaatcaaatctcctattatgaacgaaggttttgtctcttttccggtttgcaaactgcaaacaaaggcctgacggcaaaggggcaggagtcctgtttcggctcctgcccttcgagaccggacggatcggttgtactacgatacggccgtttcgtagctgctatatataataaggtatagggagaacgtgggggaatggatcccatctacctctactcgctgcggatagcttcggtcggaggcacacgcaaagcacgcagtacgggaatgaaagtaccgagaaaaaccatcagcagcatctgcaaataagtacaccccaatccgagcaaaagacgtccccggccgagaggaaacaccttgatgtcgcaaagatcggtatggaacatgacgtaccatgcggctacggccgcaggcaggaaagccagtgtcatcagtataatcccctcgccgaacatgagcgagaatacgctcctgttcgtggatcccactacacggcggattcctacttcggcgcgtcgctgctcggttcgcacccagaaggtgccgacgataccgaggaatatattgagcagaaggaagaaaccgatggccagatgattattgatctgccggacaggatcggccaatatccctgcccggtcttcactgacagcattcatcgtcagtacaggataggtatcgtccttggtcacggctttcatccttttcacgaactgctctttgaagtccggcgtatccgcttcgggagagacacgcagatagacggagtaagatatgagttcgttttgcgaaatgtactcctcggtgatgggctttaggctgatatagccggtactttcggcttcgtttttgggctgatccggtatgagtcctcgcagtgtctgattgtatcggatactcttttcgctttggacgccatcgacaacggataccatattgtagttgatgctatccgacatgcctatgtagcggcggtcgctttctcgtccttcgccattgactttctccacatagtcgagggcattgcgcgagagatagtagtcccgttggagatcgttcatgtgaagtttgccgaatcgttccgccatctcttccggcgaagaaccatcggctccatagacacgaaatacacggaaataatccggcgaaaccattcgatcctcaacgtttatgagtgatacggtgtccagttgaaagctactgttacttgacgaagaggaataatgaccgccccactgttggagacaagccgcttccactccgggatatgcagcgatcagatcgagggtttgcatcatggtttttccctgatccgcagacctctctttccattttccatccttatctttttgtacggttgccagcgtgatgcggtacacgtgttctatatcgtagttcaatgggcgtgtccaagcacgcagagctgtcacggcatagtccgtgacgaaccaaagcaggccacatacgacgagcatctccagccatatccagaggttggcacgacgttcggcgcggatgatcttgataatatgatgtagcatgataatatctgtatgatgaggttagtgggagagggattctacgatgggtgtcttggatatgcgccaggcagggataaaggcactgagcagattgatcagcacacagaagacgagagctatcaggaaaatgacgggattgaacatggctccgttgatgtcgccctgcatcattccccggctccccacgctgaggagccacgagggaaagagggccatgaccagataactcaaaagcaatccgaaagcccctcctatcagactgatcagcatattctctgccagcacttggcggactatatcggatcggacggctccgaaagagcgtcgtacgcccaattcggccaaacggcgacgcatacggctaagggtcatacccgaaagattgatggccgggatgcacagaaacactgccaggaggagaatgaagcgacggcgatactccagaggttcggtatcgtcacggtgaaatttgcggtgcatcgtcgtgaactgatcggcaggctggccgggaaaactgatattgaacttctcctgcacactattgcacttggcagtcaaggccccgacttcttccttgatggcatcgaagtccttcgggcttttggccagacagattacattgaatctggagaataggttgttcttcactctttcttcgtacagcctgaacacaggcatccacacatctccgtaagcgaagtcgcagaaaggggtcacatggcgcaccactccgcagacggtgtatttgcgcccattgatcagagcttgccggccgacggcctcgctcgaagagccgaagaaccggcgcgccaacctgtcggtaatgactgccacggcgatgttcgatcgggcatccgcctcggtataatgcttgccggcgacgaaagaaaaatcgaacacctgccagaaagcctcgtccgtatatctcgtcgtaacggggacttcctgctcgccttcgcgtacgcagaagcgcggttcaaggcccggctcaggtatggaaagtccctcgaaagccgttacggcttcgggtgtttcgagcttgcggggat

SEQ ID NO: 748 - DNA (genomic), 2112 bp, PORYPHYROMONAS GINGIVALIS; double-stranded, circular
  misc_feature 1...2112
  hypothetical: NO
  anti-sense: UNKNOWN
agcttgcgactgatattgagagccaagcgtatcaagcagcttattcagactatcctttttgattgctttgaccggatccgcttgaaatcgaagtacagacgaaagtaaggagccgttatggccacggctctcccgtctgtagcgtatatattgccgcgaataggtgccagatccaccggttcggggcgatgaagagtttctccgatggtacgccacttgtccccttcaacaaaaattgtcttcagaatcttaccgaataccacgagcaagaatacaatcatcaacgctcccacgatgcggtagcggcgtacggccttgatggtcaccggattgtttgtctcttcctgtttcatatcggtgttttatttcttgcgccgatcagtatcgacaggacggtagagaatgtatggcggagtctgcgagagtgtcagctcgaggttttgcgattggatggctttctctacattcagtttctgactcatagcagtaacttcagaagctttgaacagggcacgatagcgataatctttcacttgttcctccagacggcctatttcgcgcacctgctcgatggcttggtagccgttccaaatgttaatgacggacatcacgacgatgaccagtcccaacttccagttgctggctatccatgggtgatcgaggaaagatcctcccatcacgttccaaaaactattctttctctttgaagccgcggagtaagagttgtgaaggaatgcttcctcttctgtcgaggtctcccactcaggagagctcccttctttctcgcaaaggatgtcctcctcttcgctgatattgtttttcgcagtgtctgccattatattttttctgctattcgtagtttggcacttcttgaacgggggttgtcggacagctcttttgtcgaagctgtcagcggcttgcgagtgatctgttgccaaggactctgtggtgctccgtacagacgcaaagaatcttcatcgggtgcctttacagttccgtagcgaaggacgtttttgaccatcctgtcctcaagcgaatggtacgtcattaccacaagtcgcccaccacttctcagacagccgagggctgcttcgagcatttgctgcaaagctcccaactcatcgtttacctcgatgcgcaaggcttggaagatgcaggccaactgtttcttttcttctcgcggagagatgagaccgcgcacggcctcgagaagttgccccacagtttgcagtccgccggaaagagactccctgtagtggacaatggatgcagcaaaacgacgtgcctgtttcagttccccatagtgatagaagagggcggacagggacgaggcatcgtattcgttcaagatggcagctgcattgcggccggcacgagcgttcattctcatgtccaaaagaggactttccgaacggaaactgaatccgcgctcctcttcgtcgaaatgatgtgacgatacaccaaggtctgccaatatgccgtcgactccatcctctccgtaataatccatgaagttggcgaggtagcggaagttggaagttacaaaggtgaagcgctcatcttggagaatgtttcgacaagcatcggcatcttggtcgaacccgtacagccgtcctttggagcttaatttttccacgatagcccgggaatgtccgccgccgccgaacgtgacatcgacatagcacccgtcaggatcaatacgcaatccttccaaacactcgccgagcatcaccggtatgtgataaacactctctttatcaggacaatgcatgctggttggtctcttctaaatcttcacttgtagtaattgtattataccacgctccaaagttagccaataacgcataaacgagagaaataatcttggagatacgaacaaaaacttatcaacaccgaaggtatatgtctagattcattgctgtccgataaacctcagagtagggataaaaacgacaagtaattccagtaaataggtcgctttagagcgtttttcgctttagtaagcctccatccaaaaagattaggctccggcggggtttcttccccttgcaaattgagtttcccaatcacgttccggatgattaaagtgactgtaaaagccgacatattccc

SEQ ID NO: 749 - DNA (genomic), 6564 bp, PORYPHYROMONAS GINGIVALIS; double-stranded, circular
  misc_feature 1...6564
  hypothetical: NO
  anti-sense: UNKNOWN
cgttccacggctacagtcgtgtattgttcgacgaatgtctgtacgttaccggctatttctccggcaatgcttctggcatattctaccttggagaaatcaattccgactttacttttttgcatacttatgatatgtattcttgctttatgctatttcgtgttgttcaaaaactgtttgcattctgtcataagagcctcgttaaccccaaggatctctgctatgcgtattgcttcgtgtggaacatcgttttcgctcacttcttcaagcgtatagtccacacatttgctgagggaatttacttgtagaggtaagttcactttgtcttctctaaaaccacgcactttcaagcggcgacatggaatgtctatactgccataatgcgtagtgacgagagatcggatcttatacctgctcaatatagccaatagtccactgacaatggcttgtccttctacaggattcgttgtccttgcaggttcatcgactaaaacgagtagttgctttccctgtctggcctcatcggcaatggacgaaagacacatcatttccgccccgaaagaggaaagcccttgtctaatatcttgtgcatctccaagtgaaagcatcactttttctacagggcatatctctgccttttgtgccggcacatagaagccatattgatagaggatctgagctaatgcaactccttgcaacagcacactttttcctgccatgttagcaccggtaattaaggttggcagagagggtagggctatatctaccggctggaacttttctccttttttccccaggaggctaaggacatgtggatgtaccagtcccatatagttcgtaacactatgaccagaacccggtttactccatccaagctgaatgaatagtttgacctttgctaataacagatctatcgctcccaacaattccagagctgtagccaatcctccagcataaggggacaactcgcgagaaagtcgcttacggactatgtcttcctcctgcaaactttcattgcggatttcgatcctggcgtcttcgtttgtttcttttttgagcctgtctctcaactctctcaatgtctccgaatatgcatcgtatatatagaaatgaggaattttcttttcctccggatccaaaacggaaacgatatgcgacaaatcgggtaggggagaagagagatcatctaactggtaaaaacggatcagatcccgaatatcttcacttaaaattgctaagaacttgatctcgaaaaaatcaatgtccgtgcaaactacgtggcgtgaaagagaatatatcgtcccttggatgtcacgcagctgcattaatttgtgtgcaatttcatccagacctttttgttttcgttggtctgcttggtatgagatggctatttctacacgagaaagaagcacttcaatatcggaagcctcggtcaagaattcttgctccatcagacaacgtcgccctacagatgaatgtatgcacaactcatctattacatagcgaaagccactaatgctatttatctgttcccgtagtttcatcaacattcaagcgtgtttaaccctcttacatcgtagaccggaataccgagggctttttccatctctctgcgcagcacttcggatttcagtttgtacccgctgggtgctaccggattgattgtcacggccaatagcttacctccatacagagatttgatctcatgtttgctctgtagaaaacgatctactgcttccggcaaagcaaacatacgtgtaaaatctctgatgatgagacagattttatcatcagagaggcgaagctgttccaataagttatcactaacggccccggacacataaattctgttgccgaagcgagttaggtcatttctgttagatgcattcaacagcagtgccgaacgaatccctaagtcgtgaacgttacccgattcgtctatcccccatatgccttgttcgatgggatctaatttctctgccaattcggattccactgtgggtaaagagatcaattgatacacagcagccgttttacggaccaactgaggtatattgatggacaaagcagctccggtagctaaaatcatagcatcggtaacgacaggagatgccagacacttgcgagaaagagctccatctacaatagtcgtttgcactccggagttcgatagggtagttatcatttttcttaaccctcctgtcgtggaaggccctgagagcaaaattttaccgggttccaaagagcaggccgtgatgagccgtcccagcgcagtccgatcttcgctgacatcaataatctctgcaatcagttctttttgtagaaaatgcagctcggaggtaacaaatatcatccctttaggtaccactatttccggcttggccgtctgagtaacctggtcactcttttcaccatctatgcctatagaagtaagggcaaccctatgccgataggcatcgagtcgcctgataatatagttgagcgtttctgttttgccggtgttcttctccatcccgaaaatggatatgctccggctctgcataattttttctacaaaaggcaattttttctctctttctctctttaagcaaactctctccccaatggctttgcaaaggggagggagcttattttcattcaatcagttcttatcaaacttgcgttttttgcgagctaagtcggaaggctcgatagccaactgctgacctccggaaagtgcagctacaccctctttatgcttaccggctcgacagtcctcacaatcacactcctcatgataattctccggctccgtataggttgtgataacaccttcataattgcgaagaaccacatgtcgtggggactgagatacaacatagttcggcattacaggtatcttaccaccaccccccggagcatctaccacaaaggtaggaacagcatagcccgaggtgtgtccgcgcaaattttcgataatttcgattcctttagataccggcgtgcggaaatgacctattccaagcgaaagatcgcatacatatatatagtaaggacgcacacgcatctttaccagcaaatgtaccaatctcttcatcacatgtgtacaatcattgattccacgcaataaaaccgtttggttacccaacggaataccggcattggccattctttcacaagcctctactgcttcttcggtaacttcattcgggtggttgaagtgagtgttcagccacaccggatgatattttttgagcatatccaccaattgaggcgttatacgctgaggaaggactaccggcgtacggcttcctatacgaacaatctccacatgaggtatttcgcgcagacgcttcaatatgtattccaagcgttcgtcgctgacaaggagggcatcgcctcccgatagcaaaacatcgcggactgtcggtgtattggctatatagtcaatgcatcgatcgatgcgctcagaaggagaagaagcatctttctgtcctgcgaagcgacggcgagtacaatgacgacagtacatcgaacatttgtccgtgataaggaacaatacacgatccggataacgatgagtcagtccgggtacgggcgaatcttcatcttcactaagtgggtctacctgatcttcaggagcacgtaccagttcctgatgagtaggaatggcttgtttacgaatcggacaattaggattctcggggtctatcaaactcaaataataaggtgtgatagccattcggagtactttgagcgattcttttactccctcttcttcttcagcggtgagtgtaacgtactttttcagctggtcgagcgtctcaattcgattgaggacctgccaatgccagtcgttccattgctcatcggtgacatcagggaaataatactttctacgactttctgccatggttattgtgagctttggctaattatctaaaaaagaacgctacggagacaatgattatctctccgtagcagctcatttctaatgaattaagcgtacaattctgtgaaaactttgcgcaaagcctcacattctcgaagctcctgcagtgtgatttcagcatgacctttggtatagccattaccaacgatcatggtcacatcactgcctacgccctcagcccccaaagcagctttggtgaaacttgtagccatagagaagaaatagacgataccatcattcttcgtgcagaggatgcttgtcatttctgtatcggtgatatttacgttgttgatcgtaacatcacacatctctccattcgtaagcttttcgatctcttccattacaggcaccggcttcgttgcatcggcagagaatacatgatcgcagaaaccgagagctttcaagcgatccgtactcttctgtgagtggcaaagaccgattaccttaccggttacaccggcgcgttttttggcttcgtagcagcagagcataccgctcttgccacctgcaccgataataagtaccgtatctcccggcttcaccaatttggctgtctgagcaggagcacctgccacatcaagtgccgatagagccagcttttcaggcaaatcgttaggaatcttcgcatagataccgctttcgaagagaatagcctttccttcgatgtccacttgatctacatccggacgaatttccttgattttgtcgatgcggagtggcgttagagaaagcgacacgagcgtggcaattttatcgcctactttcaagtcgattttgtctttgagagcatcgccgatcttttcaactacgccgagaagcatcccgcctgagcctgtaacagggttacgatgctttccttgtttggctacaatgccaagcatgatttcggcgattttagccttatctccaccgggcttgttcatggatctgcgtgaaacttgcagagtctatattcaaagtcttaacatcgataagaatctcattgtcgtagatttcatccatgttgttgtccactttttcagcgggctggggtagaacgccctgaggggctaaaacacggtgtgtgccgtatttgtttcctttcttttgcattgtcgaaacgtattgagtgaattttgtgagttttggagttgttatttgctaagccccaatatccgacgggcttctgccggagtggctatctcacgacccatttccttggccatacgaaccactttttctaccaattctccattagagcgagctaaaactcctttggatatatatacattgtcttcgaaacctacacgcacatgtcctccatcaatgatagccagtgccgcgaggggaaactcatagcgtcccacacctgctacagtatatgtggcatctgcggggatactttcgcgaaggaaaacgaaatcacgcatttctccgctgataccgccatttacacccattacgaagtcgaagtgcataggggattggatataacctttgcggtgaagacgaagagccatgtncgatcatgctcttgtcgaagacttcaagttcaggtttgatgccacgctcgatcattttctccccgaaatatttgatcgtgttttccgtattggtgaacacttcatcaccgccgaagttaagggtgccacaatccaaagtagccatttcgggaaaaagctctgtcggttgcagacgttcatcattcgtcatgcccacagcacctcctgtcgaaggctggatgattacatcgggacataccgccttgatggcttccatgacttctttgaagcgatttctatcttgagtaggggtaccatcatcgtatctcacatggagatgaatgatgctggcacctgcatcataggccgatttggcttcacgtacacactcttctaccgtgtagggaacggccggattatgctctttcagaacctctgcaccgcagatggctgccgtaatgatcattttttccataatttacagtcggtataatggttttacttatttgttgcgctggcaattagccggtaccacacaagtgccggtagcacggcaaacaacaataggttcgtcaagcacatcggctgccgactccgaaatatccgtacgaggacgaatcaccttacgagcttcgaatttcatctttcgactggtatttcccacatgagtgatttcgcctacagcctctatataatctccggcaaataccggagccaaaaattccacattgtcataagcacagaagaggccttcatcaccatcttgcatgataaggagttctgtggcaacgtctccgaagagttggagcatgcgagccccatctactaagttacctccgtaatgagcatcatgcgcactcatccgaagacggatcattgatgtctttgtcatagtcgtattggagttattgtgagtagttgatttgtctaagagcagggagccgattagcggaggatatagtccacgaatatgccgctggtatggatttgttccatggggatctgtccgatggggtggatttcttcgatttctgccactacacagtctgctgccattgccatcaggggctggaagttctgtgttgtgcctttatagatgagattcccaaattcatcgccaacacttcccttgataaaggcaaagtcggcacggat

SEQ ID NO: 750 - DNA (genomic), 1021 bp, PORYPHYROMONAS GINGIVALIS; double-stranded, circular
  misc_feature 1...1021
  hypothetical: NO
  anti-sense: UNKNOWN
agaccgtttgctttggacagatcgagttctgtcagcagattggcaaagcagtcgaaagcagtcaggccggtacaattgctaatatctataaaggtagcaccatagtcccctgcagaagaacctctaaacaagaatttggccattttgccatagacgatggcctttgtttgtctgaactcaacatcacgaaactcacctgaatcgagcctctccccccgaatcgtacttgccgtttccgttgaggtctgcccaaatgtcgttggcatagccatcctcggcttctattttgattgtacactccacatcggcttcacttagctccatgataatgcgctcgccatcgacgggtgcaggaactttctgtgctgaggccgggtgaaccgatccgaagaagccggaaaggattacaagggctgagaatagcggttttcttttcataactggttagtttttggtttgtgaaaaatggttagtatttgtactgatctcatgttttcaaaatctcattgccaattcggccggagggtttgtagctgccattatccgaggttggaagaaaaaacgtgtcttccattttcatttcgtcgtagggcaacgaaggaaagcggatggatctgttttggtttgtgcgcctttctctggatagcgcctttgttcgaactgcgtcaatacagaggtattatccttgccttaggtaaggcaaatatatagagtatttcatggatattgggacgtttttctcctaaatatgtctatttataaagagcttngggcagatcgtatgctcgtcccaatgcctcgcacggatgtaactgctctgatttcataactttgacttnctaaacggtataaaattgttttcgatggcaaataatactcttttggcgaagactcgacgttatgtctgccttgtcggtnttctgttggctcatggcgatgatgcacctctctgggcaggaagtcactatgtggggggacagccatggagtggcgccgaaccaagtgcgccgaacgctggtga

SEQ ID NO: 751 - DNA (genomic), 771 bp, PORYPHYROMONAS GINGIVALIS; double-stranded, circular
  misc_feature 1...771
  hypothetical: NO
  anti-sense: UNKNOWN
gtgaatatcttcgccgtactctttgtagtagtgggcagctatctgtctaaggaaagggagcataaggcgatagcattattcaaaacatgtagagccatgggaacatatatactgtgcgtatgataatagacataacccaaataagcacccaagacgattcggggaaaaaatcccatcagatcgagatgtgcaatgctgaaaacgatggcagtcagccaaactgcagcatgccatctattgcgggtaacacggcgcatccagcgtaatacggctcctctaaaaaacaattcttccgtaatgcccggtattattgcaatagcaagcaaagcccaacccttgcctccctgcagcatctcctttatcaggcttgtataatgggcaccgctacggtcgatttcttcttgccaagccggagggagaaagggcagaaggagctttatacctttggtcgttaatactacggccaaaagacatccggcataagagagtaacagcagtactgctttgcgccaatcgatctgatacggttgtaggcccaaaaaagatgtaggcctgtcagaaaataaaaaggcttgccatacagcccctcccccgaataccacgacgctgaataagcttgtcgccaatagcaacggcaagccttcctgtccgtacccgaatagagtaggggctaagtgaagtacagagatcaggagatagccaataatcagtatcagagcaagatgactgagtataggccaatctttaaaaagancctttttcnttgcttac

SEQ ID NO: 752 - DNA (genomic), 2399 bp, PORYPHYROMONAS GINGIVALIS; double-stranded, circular
  misc_feature 1...2399
  hypothetical: NO
  anti-sense: UNKNOWN
gggcccactgataaagcaggagtatggagactgcgaatctatttcggccacacgtttataagcctcgtgcatgttgtgtacgagctttgtcttgtccaagacgatgaccaggtattccgaaataaaaaacatggctcgcttctgtatcgtctgatccacccatacacatccgttctcgcacacccctatttcaccttcgataatagccaagtccgtaccgttcatgtcgcccggattctctacttcatccggtttgtaggtagctatatgaatgtatggaagggccgatccgatccgtttggcatcgggatatgcggctctgatcacttcgttaatgtcctgtccgggctgaagctctatggcatcgccacccactgcacgcgatatttcgatgaagcgggccaccttgtccggataggtaatgggagtaaagttcatctccggtttcggctcacgctgcttggtgtgctgtttgattctgtctaatatgatttgtctgctgtccatgatgattacttcttgatattcttcttccaccaattattgaacgaagtagaggcaaagcgaggcaattcgcgccccttgccccatgcgttcaggccgttgtacagcaggaaccgaggcagactgttggccatgggagccattttcagagccgtattgaaacgccacggactatccatcaggtatttcataccggccgacatcagctttttctcttggctggcacgccccaaatgatccaaatcctgacgccaacgatagatctgctcaccgaggtcgattttcacagggcacacattcgaacaggagagacagagcgagcaggccgatacattatcgctataccgacgcggatccttgagcatccccagattgatcccgataggcccggggataaaataagtgtaggaataaccgccggagcgacgatagacgggacacgtattcatacatgcaccgcatcttatgcagttgagcgtttttacgtgctcctcattttcgatgatgtccgtccttccgttgtccacgatgatatagtgtagctctccaccttcatgaggcttgcggtagtgtgccgtataggtggtagagggctgtcctgtacccgaacgcgccagaagtcgggtgaatacccctacggcatccaagtcgggtaccaatttctccagcccgaaagagcaaatgttcaatttctgacaagccatacccatatcggcattgccctcattggtgcaaacgaccacttcgcctgtagaggcaacggcaaagttgccgcccgtcattgctgcatccgcgctgataaagtcttcgcgcaggcttttgcgtgctgcacgtgtcagatacgtagggtcgtaattgcccttctccgtacccaacttgtcatggaatagatcgcttacagcctcgcgtttgatatggatagccggcatcacgatgtggctcggtggctcttccataagctggaggatacgctcgccgaggtccgtttcgatcacgtttatacccttttctataagatattcgttcaggtggcactcctccgtaagcatggatttgctcttcacgaattttttgacgccatgatcacgcagaatgccatacaggatctcgttgtgctccttggcgtccttagcccaatggacgatgacaccgttgcgacgagcattttcttcaaatcgcagcagcagctcatccaagtgtgtcacattgagcgtttgatttcatgagccagttggcgcagatctttccccactcggggcaccgtatcacgctggatgtcgcgtttgtggcgcaccattccagagcgtctcgtcatgccacttgggctccggacttattctccaaaaagcgggcagccgcttcgctatgcttcgtactcataagtttgctgctaaaatttctactgcatgaattgtcttgatcggcaatttctctctgtctatcactccctgcatatgcatgaggcacgagctgtccggccctgtgatgtactccgcacctgtggatatgtgatccagcaccttgtcatgccccatacaggtggatacctccggctcctccaccgagtacataccgccgaaaccgcagcattcgtctattcgcttcggctcgaatacctctatgccctgcaccatctccaatagccggcgcaccttgttgtggtacggtcggtgcacttcactgggggtggacagatgcagttcgcgcacaccgtggcaactgttgtgcaggctcaccttatgggcgaatcgggaggggaggctggtgatcttcaggtcatcgtgcaagaactcgcatatatcccgaaccttggctgccganttgcagacatgtcctgtcggtctgaggatatgatcatagttttctttcacgaaagcaacgcaactgaccgggga

SEQ ID NO: 753 - DNA (genomic), 927 bp, PORYPHYROMONAS GINGIVALIS; double-stranded, circular
  misc_feature 1...927
  hypothetical: NO
  anti-sense: UNKNOWN
taatgtcttttctccccagcaggatagagaccctcacggacgcaccggcccctaccagcataccgaaggccatcaggaagatcaggattgggaaggtgatagccaagcccgacaaggcatattcgctcaccccgttcccgatgaagatgcggtctacgatgttgtatagcgaattgactgctgtacccaccaccgccggcagagcatagtgaaacaacagtttgggtatcttttccgattctaatgcttggatctgttgggatgacataaattacctctttatgctccggatcgttatcgatccgggagtgaaaaagccggcagcatatactgcagagcttcccctcctatacaaaatagaccgaaaaccctctcggactttcggtcttgttcggttgctcttcctcttggacttgaaccaaggaccctctgattaacagtcagatgctctaaccaactgagctaaggaagaatagaaaaacggcttgtgacagcgctttctcttgggctcgaaccaaggaccctctgattaacagtcagatgctctaaccgactgagctaagaaagcctttcgtttttcgtgatgcaaaggtagtgcattatcccaaacatgcaagaggttccgcaaaaaaaatacattcagatattacaaccttctcgccaccacatccgttggggcatctcatccatattcatgacagagaaagggctgccgcctccagacggtttaggctcgtgaattttccatttcgatgctccgaaaaacgtggcgcgagaattttttcgtattggttccacaagtttttatttcccgagccaaacgaaaatttacgcgcgtgttttcaggatttacgaaccatgacgtgtactgaaaaagttgacagttgggtggatagttctacaatggttactaggtcttctataatt

SEQ ID NO: 754 - DNA (genomic), 988 bp, PORYPHYROMONAS GINGIVALIS; double-stranded, circular
  misc_feature 1...988
  hypothetical: NO
  anti-sense: UNKNOWN
ttctttgccgatgggcatctgatcggacgcaaggcttcagcttgggcgaataagttttttgattgcgaacgtattccctttgcccgaaaatagtaatttagtgccttgtttgggtgggacttgttctcattcgccaaccggaaataattaggaaacaggaataatataatggtggaaatatccgccttcggtcaattgaccgacccggcactttcaccatagcataatacaagaaaatgactgatcgagaagacagaattattaacatcagcatcgaggaggaaatgaagaccgcctacatcgactattcgatgtcggtgatcgtctccagagctttgcctgatgtccgcgacggattcaagccggttcatcgccgtgtgctgtatgccatgaacgaaaccggcaatgtgtacaccaatcccactcgcaaatgcgccaatgctgtcggcgaggtgctgggacactatcacccgcatggcgactcttccgtttatatggccttggtgcgtatggcacagccgtggagcctgcgctatccgttggtggacggtcagggcaacttcggttcggtggatggcgattcgcctgctgccatgcgttataccgagtcgcgcctcagcaggattgccggtgagatgcttcaggacatagataaggaaacggtagacttccagaacaatttcgatgatacacgtcaggagcctacggttctgccgacacgcattccgaacctcctcataaacggggcttccggtattgctgtcggtatggctaccaatatgcctccccacaatttgtccgaagctattgacggatgtgtggcgtacatcgaagcagatggcgacatagacgtggagggcttgatgcagtatgtcaaggctccggatttcccaaaaggaggattcatatacggctattccggagtgaaggaagccttcgagacgggacgaggccgtgtcgttatcagaagtcgtgccgagatcgagca

SEQ ID NO: 755 - DNA (genomic), 672 bp, PORYPHYROMONAS GINGIVALIS; double-stranded, circular
  misc_feature 1...672
  hypothetical: NO
  anti-sense: UNKNOWN
taaaggtgcatggatgatctctatgcacccttcgttttgatccgatacggtcgaactcgattgtcagtcgagcgatcgagccactgacggctaatgtgcttcgagccaattagctcccacgcctatatcggcaattagcggcacacgaagttcgggcatcacgccttccacggcaacgaagatgcatacgagaagcatttcgatgcgttggaagaggcaaatagcttgccaaatcgaggaaatgaaaagtcgttcgtagagcttaaaatgatgccgatatccttcactacataatctgtttgcatttatttgtggaatgtgcagagcgacacgatgtccgaaatttgctgaaaataatgtacctttgccgcgctgattattatcaaatagtgccgaacggtttgattttcagtgcgtttttgtccgagaggagcagcccagtgtccgtgcgtaaagctcctgatgcaccggccgaatcgacagaaaagatgatcgttcaccaaattactaacaacaaaaaaacaagcagtggatactttaagcttcaagaccatttctgcgaacaaaagcaactgttacgaaggaatgggtcattgtagatgctgaaggacagacacttggccgtatgtgtgccaaggtggcaaagctcctgcgcggcaaatacaagcccaa

SEQ ID NO: 756 - DNA (genomic), 702 bp, PORYPHYROMONAS GINGIVALIS; double-stranded, circular
  misc_feature 1...702
  hypothetical: NO
  anti-sense: UNKNOWN
cgtctccggcgtacatgtctccggtgcagtacctttctctccaaggatcatggaatagtagtgccggcgaggcagttcgttctcttgccaccaaagacgcagaggcgccatgtcgtgcgtagaggtggtacataccgaacaatagggctgccgactcatatcggcaaagtcctgtcccggctctttggatattctttccaaaatgagggatagcagttgcaactgttccattacgacaggcactgcagggggtatcattcccagatcctctacacagacgagcatatccgtggaggaaagcagcggtatcagccgcgacagtgcctcttgcttccacaggtcatcgttccgcttgtggaagtagtcgtccgacagacgctgccaagctttcttttcctccaagctcagatgagcatagcgaaaagacttttcgaaatggatgcgtggatggaaggccccgggcttgcctgattctattacgaaacatacttctgtggctacacgcatcaaacctctgatcgtgtcctctcctccgacaacggctgtaggatctaacgctgctatatcggtctgatagaaattcttcgtcgccagcgtataataatccgaatcgaacggacgaaggtatcgacagcatacttcgcttgcatagcgtccgaaaatctgcttgaggtcatctgcatgaacgaagcggaagggagc

SEQ ID NO: 757 - DNA (genomic), 3058 bp, PORYPHYROMONAS GINGIVALIS; double-stranded, circular
  misc_feature 1...3058
  hypothetical: NO
  anti-sense: UNKNOWN
ccaggcgaagtgcatggcatctggcgtatgaaggagaccaaatgatgtccggcctttcgtggcacaggctttcgtcgatggagatcgggtagtagtggtggagggtttcgtatatcatcccaatgagaagaaacgcgatctgatgcggcagatggaagcggcactatacagcatgcgtccgaaggccgagaaagagttcgatccgtccattatcaggaaagctcgctggactacactcaaataaatatccgaaacggcttaccgacaacacacgaagattcaatgcaatggagaataaaaagctgaaagtggccatttcccatggcgacatcaatggtattgggtatgaaattctgcttaagacctttgccgaagcctcgatactggatctcttcacgcctgtcatatacggatccgccaaggtggcagcctattacaggaagaccttggagttggatttggaaagttggaaccaagtatcctcggcaaccgaagcggtagagggcagagtgaatctggtaaactgcatacccgaagacgccaaagtggagatgggcgtttgctctcctcaggccggagcctatgcgataaaagctctggacatggccatccaagccgtgaagcaaggcgatgcggatgtgctggtgaccatgccgatcaacaaagcagccatgccgcaggacatctttccatacaaaggccatacggaatacctgcaggcccaagccggcatagagggcgaagatgcgctgatgatcctggcgcaggataagctccgcacagctttggtaacgatgcacgagccgatagcacgcgtgccatcgcttatcactcgggagcaaatcctggacaagctgaaggctttcgatcgcagcctccgcatggatttcggtatagtacgtccgcggatagccgtcatggctctgaatccgcatgccggcgacagcggactgatcggcaccgaggaaagcgacacgatccggccggcggtgcaagaggcagaagaacagggattgttagtgttcggcccttatgccgctgacggtttttgggggtcggatatggctctgcatttcgatggcattctgtccatgtatcatgatcaggggctgatccctttcaagactctctgcatggacagaggggtcaatgtgacggcagggctttccatcgtacgcacttcgccggatcatggtacaggcttcgacatcgtcggcaagggcgaggcttcgcccgattctttccgcgcagccatctatcaggcgatcgacatttatcgttcgcgggcatcgtggcgatcggctacgcgcaatcctctccgaaagagttatttcgagcggggcaatgacaatgagaaattgccgcaaacagaagatgagcattaattttaataccctatagactctatgtttaaggataagactatcgtttacacatccgggacattcgatatgttccactacaaccatttgcgcatgatcaactatgcgcgcagtttggcagacatccttatcgttggcgtcagcacggacgaactggtcgcttcatacaaggcgccgcccattattccttttatcgagcgcttgcaaatccttgaagccctgaagacaccggacatcgtgattccgcagcatacattggatcacacggagatcgtcaagaagctgaatatagacgctttcgtagtgggggacgactggaatggcaaatacgactatctgaaggatctcggcgttcaggtcttttatttcccttacgggacgggcgtttcctctaccaaaatcaaggagactatacacgatagctatgccaagacgctgaatgaagagcgtcagcacaagcccaagtctgtccaaaacatgtaggaattatggcggtcggatacgcgttgattacgggaggaaccaaggggatcggtctcgcagtagcccgtctcttggcaagcagaggatactccctcgttcttacctacggacatgatcaggagacggcgcgagcagtggcggccgaattggcagagagcgctccatccgtagagctgctgcaagcggatgctaccgatgcgaaaggtatcgacctgatagcggaagcccttgagcagagggatattactctgcaagctcttatcatgaatgccggcatcacatgccgcacgcctttcgaggagatgactatcgacgaatggcagcgcgtattctttgccaatgtccatttccccaccttcctgatccaacgccttctgccgcgtatcgagcgcaacaacggatgtatcatctttaccggatcgctcatgggaatagaaccgcacggcatggctctgccttatggagtgagcaaatccgctgtacacgctctgacccgcaatctggtgaagcatctggagccttatggcatccgagtgaatgccgtggcaccgggatttgtagatacggaatggcagaagaacaaaccggccgaaatacgccgaaatatcgagaataaggttgctttgcatcgctttgcgacaccggatgaagtagccgaagcttttttatttttgctcgccaacgcttattgcaatggtgaggtcttgactcttgatggaggctacagcttccgctgaacagctcagacatgaacgaaaacgacaaggagtaccaagcctctctcaaatcactggagacggaaaatataattgaccggaaattctaccgtccgataggtttttactttgccaagcttctcagtcgtacaagggtaacgcccaatatggttacgatcctgtccatctttgtcggattaggcggcgggctgtgcttcgtgcatactccttatgatctccgttgggctgtggccggtattctatgtatggtagtggctaatatcatggactgcatcgacggacagctggctcgtctgaccgggatcaagagtgagatcgggcgtattctcgacggcattgccggagacatttggttcgcctgcatctatatctgcttcatcattcgcttgacagcagaagtatcccgatgccttaagttcgatgaccaccggtattcctgaattgccgtcggtcttg

SEQ ID NO: 758 - DNA (genomic), 344 bp, PORYPHYROMONAS GINGIVALIS; double-stranded, circular
  misc_feature 1...344
  hypothetical: NO
  anti-sense: UNKNOWN
cccaacaagaactcggtaaaaattatcggtgacaatacgaataaatactgtcaggcttacttcgcttacgactcgaagaaatcgggtggattcacctgctcgcaccttcgtttcggcgatacgcccatacgttctacctaccttgtggtgacaccggacttcgtggcttgccacgtgcctgcctacttgcgtatgtacgacgtgctgaaaggtctgaagaaaaaaggaactttcctgctcaattcgatttgggctccggaagatatagaacagcatctgcccaacaaggtaaagcgttatttggctaagaacaacatccgattctacacgattaacgctactgc

SEQ ID NO: 759 - DNA (genomic), 895 bp, PORYPHYROMONAS GINGIVALIS; double-stranded, circular
  misc_feature 1...895
  hypothetical: NO
  anti-sense: UNKNOWN
gccgaaaggaagacctatcggcagcggcatatcggcgataaccagattgaccggacctgtgacgatgtctttctccggatgcacctttgccttggaaagattgatatagaagtgaggatgatcgtgattgtcgcaggtcgtataacgccctccttgcataaacatgatattgtcgggcatcttcttggtcttaccggcagtcagatagccttcgcccttgctgcgtgatcactccgctgataatccccttctccgtgcggaagttgtaggtaaagttcttggcttcgaacgactgctctccatccttgaaaacaggaaaggccatcggataaccggccgtatcgaggacatagcgagtataaaccgtactgctgtcggtattgagatacatgaagtttgcctccaagcgactcttttgatagctcacatagctcttgccgaaaagataggcacgattctgtccgagcaaaacgatggaatcggcagcttcgtactccactatatcttccaattcgaattcatcgtcatacacgctatcttgccgcatcgatccggtggaatcggcaggaagggaatctcgaaaagcactgtcaggaataggttttgcgagaggcaccgtgtctttcgctgtagaatcagacagcgcagcatgccgacggtggtgcaatccgactgctccggccataggacgttccgcagcgaccaaagtagcacagagcaatccgacaaggattacgggtaataaccatgaaagtctggaacagagatcggatactctcattcggattcattcatactcacaggtgagcaaaggtaaaaaagaagttgtaatacacgatgaggttgtacaggctgccccggggccgacgcattaaattggtttgcggcttcattc

SEQ ID NO: 760 - DNA (genomic), 820 bp, PORYPHYROMONAS GINGIVALIS; double-stranded, circular
  misc_feature 1...820
  hypothetical: NO
  anti-sense: UNKNOWN
tcccagtggcaaatcgtcgtggtttgccatcttcgtcttggcgtgctcggttgagtgtaccgaagaaaagattctgcagtatggcattgtaataattcccctcggtggtgctattgggatcgaaatccttgaggatggtcttgaggaaggcaatatcgaaaagatgctgaggaaccagctccttttgcttgatgaaccaaacaaacataatacgcgtaattaggcggattatcttcgtttctagatcttctctatcatcttcacttgtactagtatcattagggaaactgatatcggcctcgggagatatggcccactggtaccactcgaagagatccttgtagaactgtttcgtcagtgcctcgacggagaaagcatcctcaatatctttgagttcgatgtcttggcgttgtttcttgtcgattaacttctggaagttgtctgctgctgtacgacagtgctgcccagggccgagcaagaaggtgaaacgcttgctgctggtaatgtcggactggctcctccccttgtggcagaaggtaaaccgccattcccacaaaggattgtcctcgtagtggaatatcataaaagcactcgaataggtgtcatgatacgcctgataatattctggatgccaaccttattgcgagccatcttgatctggctagataccgtgatgtcaaagatgttgataggattgaaatccatatcgatattgccgatatgctgatctctaggatgcccgttgcttgtgctgctggtcgtaggtcgggtacatctctaggatagatcaccatgaccatcctcaaatagctctgaccaa

SEQ ID NO: 761 - DNA (genomic), 552 bp, PORYPHYROMONAS GINGIVALIS; double-stranded, circular
  misc_feature 1...552
  hypothetical: NO
  anti-sense: UNKNOWN
tctttggtttttcattttcatcaaaattattttttgttgcatttgcatatatttcttttgattcatgcgctgcaaaggtagcagcaataagaagaaaagcgaataaattcagtataaacgaattgaagccgaacaggaggaatagacaacggccgaatcttcggatttctttgctttcccgatattggaagtatccgtaccttcgtgctcggctgtggccgacaggcccatgcagcgaattaagaaacgattgtaggctgtttcttgctccctgcacgatgctggaagccgttgtcacgtgacaatcactccgtgcatgatgcaggaagccgttgtcacgtgacaatcactccgtgcacgatgcaggaagccgtcgtcacgtgacaatcacgtcctgcacgatgcaggaaacgattgtcagccgacaatcgtttcgcgcacggctgttttgacctttcgtcgcctgacaatgcttatataaaagctgtttcagggggcagtgtcacttgacactgctaccaataacagattaataatcaatcaaatacaaca

SEQ ID NO: 762 - DNA (genomic), 793 bp, PORYPHYROMONAS GINGIVALIS; double-stranded, circular
  misc_feature 1...793
  hypothetical: NO
  anti-sense: UNKNOWN
ggaaagactactttcacgctcggattgctacgattgcttcgaaggcgcggtctcaaagtgcagcctttcaaatgcggtcccgactatatcgatcctaagtatcaccgccttgcatgcggaacggaaacggtgaatctggatgctttcatgatgagtcgggagcatatcgcccgactctatgatcgctacggcagtgaagccgatgtttctattgtggagggagtgatgggcttcttcgacgggtacgaccgtatgacgggtagcagtgcccttttggccgaaaatctgcgcattcccgtattgcttctgatccatgcaggcagcacggcctattccgtggctccgatactgtatggcttcaaacacttccgcccgggtgtggctccggtgggtgtcgttttcaataaggttggctccgcttcgcattatcgctatctggaggaagcagctgcggatgccggtgtggccagcctcggttacttgccgaagatgaaagatttggaaataccgtcgcggcatttgggcttgtctgtggaggatttagtccgttatgattatttgccggacagggtggcagatgccatcgagaagtatgtggatgtggagagattgcttggtctgatggcctccgatgtcgatccggttatcgaagaagagagctttacggagtcttctttgcacgggaggaaatgcattgcggtggcggatgacgaagcatttaacttcacctatcgggagaatattcgtcggctcgaaagccgggaagggtttgttcgattcagtcctttgcggg

SEQ ID NO: 763 - DNA (genomic), 912 bp, PORYPHYROMONAS GINGIVALIS; double-stranded, circular
  misc_feature 1...912
  hypothetical: NO
  anti-sense: UNKNOWN
gcgcagtagccgaagcatccgattcttctgcctgcaacaatatatacttagccacgccatcgaagctgagagcatacctcgactgccccaaagctttgttgtttatggtcagtagttcgtctgtaccatataggatatcctcgatcaacttcttccgggcaaatcgcgcaaaggcgttttgatcgtcacatcgtacttctcgcacaatgcctctatttgccaaaagaaaagattgtttttgtatttgcccaatggctcaatgccaccttcgtatatactcttctcacgagatggaatgatcttgtccatatccggcagattcacttcgcccaagcccttacagcgcggacaatagccatgaggggaattgaaactgaaattgtgcggagccggatcgctatacgaaattcccgtatcaggacacatcatcatccgactaaaatgtcccacttcgtttttttccgaatccaacaccatcacaagcccttcgccttcacgcatagccagtgccaagctctccgctatacgtttgctttgattcgatgctacgcacagcttgtcgatctgcacttcgacgtcatgcattttatagcgatcaagcttcatcccatgcaaaatctcgcgaatctcaccattcacgcgtacgtgcagatagcctttcttacgaagcctttcgaatagctccttataatgccccttacgcgagcgaaccaccggggctaacaaagctatcttacggccatcatacttttccaaaatgaggtggaagatttgctcctcggtgtatttcaccatcttctttcctccggnataagaataagcctnagcaacacgagcatagagcaaacgaaagaagtcgtacacctctgtaacggtaccgacagtcgatctcggattccgattggtcgtctt

SEQ ID NO: 764 - DNA (genomic), 348 bp, PORYPHYROMONAS GINGIVALIS; double-stranded, circular
  misc_feature 1...348
  hypothetical: NO
  anti-sense: UNKNOWN
gatagtgcagacaaggtgacggtggagctcgtggacaaggcgaaggtcatctatatgcctcgtatgaaggtcaaaactgctctgaagggcgtccgtatggagcgtgccgagcgtgtccttgatgtgccttacgcctcttcggtcaagccgaatagaacaacagcggtggatcttcatcctcggacaacaacgaacacaccgggctgtaaacaaagcatttaatagtgacaacgataaatatctgaacgtccttattcgacaatacatccctaaagattcttcgttcatcgatataacgaccaaacagatctccattatgagacctttgaaaaataataagtggaggaa

SEQ ID NO: 765 - DNA (genomic), 1217 bp, PORYPHYROMONAS GINGIVALIS; double-stranded, circular
  misc_feature 1...1217
  hypothetical: NO
  anti-sense: UNKNOWN
ttgcacaataagcaggcactttatccatttatccattcattttattgtgtgtcggccgattgttttgtgtgtttatggtatgatcaatgacacaaaacgatggcacgacaaggaaaatcatccgacgaagaggtttcgttcagggacgtcatgtcagcgaatcgatacaggaaagcacggaatgtattttcgaaccaagtcgatatgcttatcgattggcaacgtattcgggcactgctctctattcacttggcagccatacacctactcattgatctttccttgagatacaaagaatgaacttccacgagaggatactatgatctcacatgagaggatactatggtctcatatgagaggatactatggtctcaaatgagaggatactatggtctcctatgagaggatactatagtctcacatgagaggatactatggtctcatatgagaggatactatggtctcacatgagaggatactatggtctcatatgagaggatactatggtctcacatgagaggatactatggtctcatatgagaggatactatggtctattgatggaagatgctatctgctctctgccggatggcaggttcngggagttggaggtccgtgcgagctgtaaaccgatagatgagactgtcgcacggcattttccggagatttcattgtcaattgactgattttcagtgtctgtacagatataagagacctttgcacgccaattgccgtgcaaaggtcttctttaatttatgcagaacgccggggataattatgtcctcatccgtaggataaggcataaccacccttgaggagctcgtgcaagtagctccgcaagggggatttacaactactttcactccttactgccaccttttccctccacctccttatttttcaaaggtctctatagaccgataatcagagtctcgccacaaagagactgtaaagacaaaagcctatccatgtatgccctatcggcaaagcatgaacaggcttttttgtggtcaatcctcggccaccgttatatgagatttatattcacagcttttatctacccgccaaaaagatatatttttgccggtgaaataactctctcccccttcttatccttttcagctatgcgttggttcatactttgtctccgcaaatatgtagacttcaagggccgtgcccgtcgcaaagagttctggctcttcaccctgttttatctc

SEQ ID NO: 766 - DNA (genomic), 3162 bp, PORYPHYROMONAS GINGIVALIS; double-stranded, circular
  misc_feature 1...3162
  hypothetical: NO
  anti-sense: UNKNOWN
cgacaggtaggcgatctgtcgcaaagcatcggattgggggcgggatataaacttgagtaggttcgatagaaaacgaattgatgctgctccactcagcgacaaagattcgtccgacatcgggataaggggatagtcctcttcatccggttcgggttgataagagagcatggcacgagctatctcgcgagcctgataagttttgcgcacgagaatagcaatatccgaaggagcataccctcttttttgcagaccgatgataaaacggggaagatcctgcaagatctgctcctcccacgaaagattggcttccgcttcttctgatgatgccggcgacggaagataaatgcagacgcttccatgccggtctactttagccggtggcacaagctgctccacatcggcataggtctgcatgaatgtacggttgatctcctccggcaacttaggatcgggcattgccatcgtctcggcttcgcgagtcatagcctcacagaggatttgtggcagatgcttgtagagggagttgttgaactcgattatttcgggagtgcttcgccaattatatggtagattgaccctctccgatgtttcggcaaaatcccgactgacgacctctgtgagcagacgccggtcggcattgcggaagcggtatatactctgtttggcatcgccgacgaggaggttgtacttgccgtgagccagactctcggacagcaggggcttgaagttttcgtactgtaagcggctggtatcttgaaattcatcgatcatttcgtgttcgatgcgtaccccgattttgtcatagacgaaaggggtctcgctcccgtcgatgatcctgtgcaatagagacggagcatcggaaatgagcattttgttctcttcttgtctgattccttcgatttgtcgccaaaggtcggagatgataccaagccggttcagaaagggaagcgactgcttggccgtggaatactcttgccattccctgccgagatagagtgttgccatttcggtcagacactctttgagaccggattggtaagccgagaggatggctgcctgggtggtggcaggagtggttttggcgtagagtgtggtctccggatcgccttctgccatcgccataaaggtctttgtgggaggcttgacttctcctcctttgagcaccttggcaaactctaagatacctcctttggtaccccctttgaaatcgtagaagctgattccggctgtggcgacgatttcttccgcccgacgtgcaatagacagacgtcgctgttcgaagccttccatcagcttgttcatttcggtttgatagcgatgaatggcagctttggtcggtagtttgccttcctcggatagcaggagtagctgttctttgaaaagctcatcacccaagctgactatctccctgcggatgttatgtccacgcccctcttcgatcaggtcttcagccaaacgcctgatccaattctcgacgtcggaggtatctttttctcccaagctgtgcagcaagacggacgacagcctgttcgagcacggccttctgctccatctcgatccgaaaaccacccggcagtcccaattcatgagagaaggcacgcattacttcctgaaagaaggagtcaatggtcttgactcgcaaagaagaatagtcgtttagtatttcggtcaggacttcctgtgctctgacttgtagctgctcggtagtcagagccaactcctgcatcagctcctcggcgaaaggggacgatccgcccacagccagactgtacagctcctcgagaatacgctccttcatttcggcagtggctttgttcgtgaacgtgacagcctgtatataacggaaagccccgcgcgtacgcagggctaaacgaagatattcgccggtaagtgtatgagtcttgccggaacccgccgaagctgtataaatgcggagttgcttggagcgtttcatttgtttttcttgtgtccgggggcaagacgataagtccggtcatagaggaagagagccagctcgcgcggattcttctcgaagcgagcgatagtctctggcgggatcggatcgccgatatagacatcgaaaatatgccctcgcttattgaatagctcggcagggatgcgcggagtccgaatagcccagctcagccatccgaggaagtgaaaataccaggaattgcggccactgaagaaaatcggataaacgggcacctgactgacgagtatcatcttggcacaactggcttgccattcgctgtccatcacccgattgcgattgcctttatagacggatattcctccggccgggaagaagccgaccggctgaccgttttgaagacggttcagtacctccttcactccggatacattgtgcttgctgtcaagtcctccggccattcctttgagtggagccaccggtatgaagctgtcgcgcaggcagctgatcatggacagaaaaccattgaccaatacgctataatcgggacgtaccgatccgataatatcgatcaacataatgccatccagagagccgaacgggtgattggataccgttgtaaaggcaccgcccttgcgcatctcttccaaatgctctgccccgtgcagccggtagcagacattgatggcggggtcagtcagtgcagcatgggcaaactctgctccacgcagattgatatgacgggcatggacggcgttgatgtccgttatcttgagggctttcagcaaccggcgcgtcagtcgtcgctcccctcccagtacgggaaaaagacgaagtacatcttcttcggtaagaacttccggacgtgagtctgacatgagcgatcgggtattaaggatcttcgagttgcctgagcgtatgattaccgcctctctttcaggtgatgtctgcacatggcctcgtgtcgtctgataccgaggacgagcactgtattcagaatcagtatttcgaacacgaaatagagccaaatatgaccgctcaagacgataagaaaaagaggaatggtacggccgttgaacgtaaggaagtccacgatattcatgattcggcggctatccttacgcagatgctgccgaagcgtttcggggatggtattttgcggataatcggcctccaattggtcgagaagcctttgcagccggggtgtcgcacgttcctgtatcaacgta

SEQ ID NO: 767 - DNA (genomic), 695 bp, PORYPHYROMONAS GINGIVALIS; double-stranded, circular
  misc_feature 1...695
  hypothetical: NO
  anti-sense: UNKNOWN
tatggtgcaggccggcgtgctggaagagaagaaaaaccggatcatggaagtaatggtgtcctccacacggccgttcaacctgatgatgggcaaaatcatcggtatcggtctcgtaggccttacgcagctcatctgntggggagtgctcacggnactgctgctgacggtagcacagatcgccttcctcggcaatctgtacagcccagaggccctgagtcggatgcaggcttccgacataacgggcatggcctcgtccatgaatgcagaggacttcgccgagatgaaggaagtgatgaacatcatcgggggcatcaacttcggagagctgttcgtgatgtttctcatcttcttcatcggcggctacctgctctactcctcaatcttcgccgttatcggatcgatggtatcgaacgacgaagacaccagccagttcatgatgcctgtgatgatcctcctgatgttcggcttctatgccgcctacggcagcatgaacaatcccgaaggatcgctcgcattctggtgttcgctgatccctttcacttccccccttgtgatgatggtgcggttgccctacgacgttccgctgtggcaggagttgctaagcatcggcctgctgtacggatgcttcgtattgaagaggtggatcggggcgaagatttaccgcgtaggcgtgctcatgtacggaagaaagccat

SEQ ID NO: 768 - DNA (genomic), 683 bp, PORYPHYROMONAS GINGIVALIS; double-stranded, circular
  misc_feature 1...683
  hypothetical: NO
  anti-sense: UNKNOWN
tcgttcctgtcttacccgatttcaatgcagccgatgcagcaagtatagtgacgcattccgatgccaagtatctcttcgtatcggacaaaatatgggagacgatggatccgtctcagctccttctcctgtgcggagccgtctctatccgtgattatacggtcttcctggatcgtacggagggtggcttgctcagccaggaagtagaaggattgagtcgctctttctccgaacactacccttccggcttcacggcagaggatattcgctatgccgaggtgtcgaacgacgatctcatcctgctgaactatacctccggtacgaccggattcagtaagggggttatgcttcgtgccaacaatctggccggcaatgtaacctacgttaaggatagagacattatgttccgaggcgagacgatcctttgcttccttccattggcccatacttatagctgtgcgttcaacttccttacgccattgactataggtgtgcatgtgtatatcttgggcaaaatcccctctcctctcactctgatcaaagcctttgcagatgtacgcccctcatttgtcatcatggtgcctctcatcatagagaaattgtatcacaaggcaatagctccgaaaatcaagacaccgttaatcaaattcctgctaagacttcctgtgctgaaaaaggtgatacac

SEQ ID NO: 769 - DNA (genomic), 666 bp, PORYPHYROMONAS GINGIVALIS; double-stranded, circular
  misc_feature 1...666
  hypothetical: NO
  anti-sense: UNKNOWN
gaaaaatgctgtaaactgaaataaacttaccatatcgtttttttataagacagaatgccttctgccggaaaataacgccggttccctattttgaaagacggtaatttcccgtttcttccccacctcaaagctgttttgaaatgtattcgcaaaatcctcgctacatcaaaagcatcgtaatagatttgttcctcctttttcaaatttttctctggcatcatagtttcaggttgtaaagattattcgtttgttgttcaataattccattgtttcgcatataactgatataactcttggccgtacggtctttgacgtcgaccgtttgcatgattctttcgaccagttcgttgtaagataaatgctcttgggcgtgaaagacttcttttgcgatttgtcccaattccgtaagtttccgtttttctttgtcttccggagatttctctccccggtaaacgtgcatttccttttccctgtcccatccgaacagcatcaaaggtacatccaacgggcttccatcccttactttaagtgcttttacgaccgacaaagccggattctcatctttctctatggagaggatggccgccgacttgcgctgaagttccgaaccgatatgcccacgcagtttaatccgttcggacaaaatggagtacacagataatacag

SEQ ID NO: 770 - DNA (genomic), 992 bp, PORYPHYROMONAS GINGIVALIS; double-stranded, circular
  misc_feature 1...992
  hypothetical: NO
  anti-sense: UNKNOWN
tgatggaaaagtaagatttttcatagttaaggttttggttaatttgggaaggagtgagtcgtgagactcgctccttttatgttctgatactcttgtctatcgtctcttgtctgaatttatcgttatttttccctctatatgaaagagtttcagtactttcgcgggcaacaaagttaatcgatttcaacaacaaccaattaagcaataataatacgtactatggctctaagatttatcactgcagaagaagcagcggagtttgtgcatcacaacgacaatgtcggctttagcggttttacccctgcaggcaaccctaaggtagtacctgcggcaatagccaagcgagctattgcagcgcatgaaaaaggcaatcccttcaagatcggtatgttcaccggtgccagtaccggtgctcggttggacggtgtcttggcacaggccgatgctgtgaagtttcgtactccatatcagtccaataaggatctgcgcaatcttatcaacaatggcagcacttcctatttcgatcttcatctctctactttggctcaggatctgcgctatggcttttacggcaaggtggatgtggccatcatagaggtggcagacgttaccgaagacggtaagatcctgcctactacaggtgtaggtatcctgcctactatttgccgtctggcagaccgaatcatcgtggagcttaacgacaagcaccccaaagaaatcatgggtatgcacgacttgtgcgaacctctcgatccgcctgcccgtcgcgagctgcctgtctatactccttcggatcgtatcggcaagccttatgtacaggtggatccggccaagatagtcggtgtagtgcgtacgagcgaacctaatgacgagagcgattttgcgccccttgaccctgtaacgcaggctattggggacaatgtggctgctttcctcgtgagcgaaatgaaagccggacgaatacccaaagattttcttcccctgcaaagcgg

SEQ ID NO: 771 - DNA (genomic), 5351 bp, PORYPHYROMONAS GINGIVALIS; double-stranded, circular
  misc_feature 1...5351
  hypothetical: NO
  anti-sense: UNKNOWN
ggggaatctgtcggaatagtgcctgattttcggccagactgttttcgaagtattgttctttgaagagaaagactcctacaggattggcgatatttttcttcacggcctctttctgcgcgatggtgtattcccgttccatctgatccattttctcctctgctagctcttccgtgagggtggaatcgctgtaaatttcattcatcttgttcataatttcggccattttgctgcgtatctcttgatagatgtcgttcgtcggggtaccggtgacggattcgtttccgctcttcatctttacctcgatgtgtccgttctcaagaaagaacggaatgctgaatacatcggtagcggtcatacaggagaggtagcgagcgacggtcgaatcctgtctgcctttgaagctgaatgtgccgttgcggatgatggccgaatcaagacgggtgacttccatgttttcgatagattcgaggaatacggtatcgccatcggcggcatactccacggtgccaacgatcttgtatccggattttcctttgtcagagcatgaggcggacagcagggtgatagccgtggccgctattgctatataagtcagcttcattgaagctgcgagaagatttattcgtttcattggttggatttgtttttggatttcacactggtggcaaagttattgttttgggctaaagtgcggtatgcaaccgaaagagccgctgccgatccgagtatctgattctctcttctcctgcttgattcgggaaagttatgcacaaaccaattccggtgtcagcacctttgcagacgattcgtggcgaaaaaatgcctgcggtaccatactgtctgcatcaggctgcgcgtgaggaggtagaggacgaaggcgagccaaagggctgtctcgcccaaggctccacgaaggaggaagaaagtggcgaagaaaacaacgaaagcagctgtcatggctctccgcatggcttttgatgcagtggcccccacgaatactccatcccacaggaaagcggcaaaggagacgatcggtaccactcctgcccagaaagcaaaacggcgagcatgctctatcacttcgtatttgtcactcagcaccgaaagcaaagcggccgggaacagcagatagagcaaggtggccatgagggagacgaccgtcccgatgcgaaaaaggcgatggatcatcaggcgcaattcgtccgaccggcgtgcacctatgtatcgtcccgtaagtgcttcgccggcgtaggcgaatccgtccataaagtaggagaagagggtgaagagttgcatcagcagagcatttgctgccacagtgatctctcccatagcagaggacgcagaggtgaaaaagagggtcaccgtaccgagcaaggcggtgcgaacaaaaaggtcgcctccggtgcgcaggtaggctccgtagcccgaagtatctgtcaggctgcttgcgcggaaaaagcgcagtacgcgtcggtagcgaaaaaaggcaatgcccgagagtaatgccagaccgacatattgggcagcgatcgttccggcggcaagccctcccactctcatatcaagtccctgtacgaagaaaatactcaggccgatattgaccatattggaaacgatggctacaaccatcggaacgcgtgtgtcctgcatccccacataccagccgttgaagacatagacgagcagggctgcgggcgctccccacagagcgatgcggatatattcgcgtgcctctcgtccgatggtctcctgacccgaagccagcagatacccgaagcgttctgtcagaggagctgctatgagaagaagcagggctgcgacaactgccatcgcgatgccacgtgccagatagcgtgtgatggctcgcacatcgctacgcccgaaagcctgtgccgtgaatcccgtagtccccatacggaggaaggcgaagagccaaaagacgaaattgaccacccccgaagccacagccactgccccgatagagtcggccgtgtccatacgaccggccagccctacatccacgatggagaggagcggtacggtaatgttggagatgatattcggaatagccaagcgcaggatgcgcctgttcatctcacgccccgcggtcagtcgcatgcggatagggaggagttgtcatgaggttcggtcagataggaaaacagtccggccgtgcactcttccagaatgtccagcaccagctcgaagccggatgctcctccatagtacggatcggggacatggtcgtgaataccgctactgctgaaatccgtcatcagacggatcttggccgcagcctcttcggtcggagccagttcttgcagccgctctcgattggcaaagtccatgccgatgatataatcgaatcgttcgaaatcctcatactccaccggacgggagagcgaagtgagatcgtagccccggcgagcagcgtgtgcacgcattcgggcatcggccttttccccctgatggtaattgctcagtccggccgaatcgatgtggaagcgatcggcatgcccctgctcttctacatacgagcgaaagacagcctcggcagacggagagcgacagatgttgccgagacatacgaataggattttatgtggcttcataagcggattatcgaagcaaaggtagtcgcttggtacgcagtcgcaagctgttggtcaccaccgaaatagagctgaaagccatggcggcccctgcaatggcagggttcaggaggaacccgttcacggggaagagcagaccggcggctatcgggatggcaatcagattgtagcacatagcccaaaagagattctctttgactgtacgtcttgtggcgcgcgacagctcgaaagcagcaggcagcaggcgcagatcggagcgcatcagcgtgattcctgccacttctatggctatatggctgccatcacccatggctacgctgacgtccgccgtactgagtgcctcggagtcgtttatgccgtcgcccaccatcgctacgtggtgtcccttgtccttgagtattcgtatatagtcggccttgtccgagggcatcatgccgccacgataatcctgcaaacccagcttgcgagccaatgcttccgctgtttcggggcggtcgcccgtcagcataatggtgcgaatgccatgtcgatggagctgtgcgagcacctctgctgcctgaggttgcagttcgtcggtcacacagaaacgtcccaataatctttcggcacgtgagaaatagaggatggctgcatcctccgacagagcggttatatccgtcggtatctgtgcgccaagctcctcgacaaaggtctggttgcccactctgtagatctctccttcgaaggaaaattcgatcccacgaccggggaaattctggacttccgacagctcctccgtcctgccgtcttcggcaaaggctcggcaaatggcagctgcaagtggatgcgtgctaagaatctcggcggagtagagcagccggcgtactttcggtacatcggtatccgatacaaaccaatcgataccggtcacttccggcttgcctatggtgagcgtgcctgtcttatccaagaccacggcatcgatggtagcgaaacgctccagtgcttcggcattgcgtacgaggataccatttcgtgccgagcgtccgatccctacgaccagagccgtaggcgtagccagaccgagtgcgcacgggcaggcaatcaccagcaccgatatggcacagaggagtccgtagaccgaagcatcggctgctcccgtcagttgccatataatataggtaaggatggatagcccgatgactatgggtacgaatatgccggcgatccggtcagccagacgttggataggcgctttgctggcctgtgcctcgcggactgtgcggatgatgcgcccgagtaccgtgtcgctgcctacgtgagtagactgtacggtgaggacaccggagccgttgatcgtgccggagaaaaccatagagccgacttctttctctcgcggtaagggctcgccactgatcatgctctcttgtacggagctgctgccttcggtcacgataccgtccacgggtatctgctcgcccggacgtacgcgaacgaagtcgcctgcgacgagcgcagcaatgggcatcacggtctcgcgtccgttgcgcacgaccaatgcctccgccggctgtagtcgcatcagttcacgaatggcttgccccgtgcttcggccggcacgcttttccatgagtttgcccagtaggacaaatgcgatgatcatggccgaagcatcgaagtagaggtggagcttcatcccggccggcccttcgcggaaaaacagcaggactatcaggctataaaaaaaggagatagtggtgctcaacgataccagcgtatccattgaaaatacgccgtggcgcagttgcttgagtgccgatcggtggaaagtccttcctgcccatgtgtatccgggcaaggctatgagcatcatcaggtagggcatcatctggaaatgcggcattagcatcagaagcatcagcaggatggcggacgaccaagctatgatcgtatcgcacttcatccgtctcagttctgctgcttccatggcatcgcgccggcgaagttgctctgcctccgaatcctccactatcaggtcgaatcctatgctgcggatagctttgcgcagatcctctgccgaagttaacctttcgtccaccgatacagagagtatattctcggcgagttggacgttcgcatcgctaatgccttctaccttggaggcagcctgctctacgctatgcgcacagccggcacaccgcattcccactacgggaaaaacgtttttgctccttcatatcacggggactatcgggttataaggattgggcttgtcagagcttacactcgaatccggcgaggcgtacagccttcattattgcctccggtgaggttgtctccggagcataatccactgtaagactatgggaatccagagaagcgaatgccgtttgtacgccttgtacaccgagagctgctttctctacacttgcagcacaaccgccacacatcatgccttctacggaaaaggtcgttgttttcatcttgacgagtagttttttcttatgatcctttgtttttgactttggcttgtacatagctgatctacggcaagccctcgttcggactactgtaaggtatgcataccggactcctgcatcgtccccgactgtagtctctctctattatatataaacgaaacaaaatcagtagtcggatggttcgccggactgcggatagtggtcgagatgaaaatgcgaagtggcgcggaaaaaacttgtttcatgtccctgaaaatgccgagcgtaaaatttttcg

SEQ ID NO: 772 - DNA (genomic), 629 bp, PORYPHYROMONAS GINGIVALIS; double-stranded, circular
  misc_feature 1...629
  hypothetical: NO
  anti-sense: UNKNOWN
ggacaacatcgtcaatacgatcaatagtctgcgcgatacgattgctattacgttcgtcatcgttattcttgtggttctgtttttcctcggacgatggcgtgccacatttatcatcggtctgacgatccctatttcactggttgcctcctttatctacctgatggctacaggcaatacgttgaatatcatttctctcagctccctctctatcgctatcggtatggtagtgggacgatgccattgtagtgctcgaaaacgtaacgacacatattgaacggggcagctatcccaagcaggctgccatacacggcacgaacgaagtggggatctccgttatagcttccacgctgacgatgctggctgtattcctcccattgacgatgattcaggggcttacgggtatccttttccgtcagttgggttggatcgtgagtattatcatgattatctctacggtagctgctctcagcctgacgccgatgctctgttcgcagttgcttcagcgcgacanaaagcaaggacggctgcaacaaaagctctttgtcccgatcgaacgctttcttgattctgtagaatcgagcatatgagccgtttcctgaattgggactgtgagacacagaaccggttac

SEQ ID NO: 773 - DNA (genomic), 671 bp, PORYPHYROMONAS GINGIVALIS; double-stranded, circular
  misc_feature 1...671
  hypothetical: NO
  anti-sense: UNKNOWN
gggcaaaaactcctcgaacaactgatcttcacctttgggagtagggccggaaataatcaaaggagttcgggcgtcatcgatcaatacggaatccacctcgtcgactatggcgtagttgtgcttacgctgcaccaagtccttaggactcgtggccatattgtcgcgcaagtagtcgaagccgaattcgttattggtgccaaatgtaatatctgcattataggccttgcggcgggcatccgaattgggctggtgcttatctatgcaatccacggttaaaccatggaacatatacagtggccccatccattccgagtcacgtttagaaaggtagtcattgaccgtcactacatgcacgccgttaccagtcagagcattgaggaatacgggtagggtagctaccaatgtctttccctcaccggtagccatttcggcaatttttcctttgtgtaagactgtaccaccgatgagctgaacatcatagtgaatcatgtcccacaagatttcattgcctcctgccacccagtggttttggtagacggcggtatctccctcgatcgagacgaaatcatggttgattgcgagatcacgatcaagatcagtggctttgactcgaatagttcgtttgggcgaatctgcgacagtatctttgataatagcaaagcttcgggaga

SEQ ID NO: 774 - DNA (genomic), 1112 bp, PORYPHYROMONAS GINGIVALIS; double-stranded, circular
  misc_feature 1...1112
  hypothetical: NO
  anti-sense: UNKNOWN
ggacactaatggtgaaaatagcgaattgtcggtttgctgttgttataaaaaacaatatctttgttcccatcgtagtggtccctgctcgtctcgaacaagctgagtggggtgtaagagggaatcgggtgagaatcccgagcagtcccgctgctgtaagcttttaccgccgtgtcggttttgacatgcggactcttgtcgctttccaaatgatgccactgttcattctccactattagaggtggagctgaatgggaaggcgcgacaaacagaaaagagatgaagtaagccagaatacctgcctctacgagttgcctataaagtatggagagaagacctcgaggaaaggagtctccccggcactaagagaatagatctcaggaagtatttttttacaataacgtattacaatggaagaggtaatccttcgcatcgtaaagcgtgatggtcatgtgcagtcgttcgatccggaaaaaatccgtcaggcgataatcaaggcttatcgcgcaggaggtgtgcacgaagaagctgcacgtatcgacaatattgtccagtctgtaaccgattttgctcgtcagagcggtgagcttgtcaccgtggaacaaatacaggatcgtgtcgaggaggaactgatgcgtttgaatcctttcattgccaaaaaatatattatctatcgagagtggcgcaccgtagagcgtgacaagcgtacatccatgaagcatacgatggacggcatcgtaacgatagagaagaacgatgtgaatctgggtaatgccaacatgagttcgcatactcctgcaggtcaaatgatgacttttgcttcggaagtaaccaaggactatgccagcaaatatctgctttcgctacgctatagcagagcacacagggcaggagatatacatattcatgatttggactattatccgaccaaaacgactacatgtgtccagtatgatatagcagacctctacgaacgggggttccgtaccaaaaacggcagcatccgtacaccgcagaatatccatagctatgcaacgctggctaccatcatattccagaccaatcagaacgaacagcatggcggacangctatcccggccttgatttcttcatgg

SEQ ID NO: 775 - DNA (genomic), 2957 bp, PORYPHYROMONAS GINGIVALIS; double-stranded, circular
  misc_feature 1...2957
  hypothetical: NO
  anti-sense: UNKNOWN
tgcgatttcttgtatctgcccggtggttatccggagttttacctgccggcattgagtgccaacgaatccatgaagcggtcggtacgggactatatcgagtcgggaggttatgctctggccgagtgtggaggtatgatgtacctttgcgatacgatacggggcatggacggacgggactatcccatgtgtggcgtattgcctgagacggctacgatggaaggaatgcgcctgcacctcggctacaggcgaatggtatacaaggggaaagagctacgaggacatgaattccactactcttcgactatcggctctacgccgtccgtggcacagcagtacaatgtgcgaggcgaagccgtggagactccgctataccgatacaagaatctcttggccggatatacgcatctctactggggtgagcatgacgatctgtggatgtggttcgactgatggaagcgaaacgatgtaatctatgatatatacgaagacaggagacaaaggaaccaccggcatattcggtggggagcgtgtgccgaaagatgatgtacgagtggaagcctacggcacgatggatgagctgaatgctgccatcggcatgatccggacattcctgccggaggaggatgagcgtcagaccgtgctgtacgatattcagatgcggatgatggcagcgatgagtatagtggccactcctgccggcaagcgtgagcagaatcccaatcatttccccgaagaagcagcagccaactgcgaggcttttatcgacaggcttttggccgaaacaaccgacaacggctacttcattcttccgggcggtacgccgctttctgctcatttgcagttggctcgtacgatagcacgccgagtggaaagaaggttgtggacactgcaccgatccgatgaagttccggatgcaatcttgaagtggatgaatcgcctgtccgatcttttcttcgtgatggctcggcacgaaatgcagcagcagggttggagcgaggagaagtggcatagattcgcctataagagaaagaagaaatgacggaaggcggaaagctacggccgattatgtttgtcggcacaggcagcgatgtaggcaagagtattatcgctacgggtttctgtcgcatttttcggcaggacggttatcatccggccccgttcaaagcgcagaatatggctttgaattcgttcgtcacgcccgaaggtttggagatcggacgagcgcagctgtgcaggccgaagctgccggcatcccatgtcatacggatatgaatcccgtgctgctcaagccgagttcggatcatacttcacaggtcgtgctcaatggccgtccgataggcaatcgggatgcttacgaatactttcgacgagaggggagggacgaactgcgtacggaggtgtacgccgctttcgaccgcttggcttctcgtttcggccccgttgtaatggaaggagcgggcagtatatccgaattgaatctgcgcgataccgatatagtcaatatgccgatggccatccatgcaggtgcatgcgtgatccttgtggccgacatcgaccgtggaggcgtgtttgcttcggtctacggttctatcatgttgctctctgccgaagagcgaaagtatgtacgaggcatcatgatcaataagtttcggggcgatcttcgccttttcgacgaagggaaaaagatccttgaggaattgtgcggtattcccgttgtgggagtaattccttactataaggatattcatatcgaggaggaagactccgtagcactgtcggtcaagcagtatgctgccggacagggacgggtgaatgtggctgtagtcctgctgcgatacttatcgaactatacggacttcaacgttttggaacgcgatcctcgcgtacacctttattatacgaacaatacggaagagttgcgcaaggccgatattatcattctacccggcagcaagagtaccttggccgatctctatgaattgcggcgcaatggtgcggcacaagctatcgtacaggcacatcgcgacgggacaacggtattggggatatgtggcggattccaactcatgggcatggaggtttgcgatcccgaccatatagagggcgatatagaacgcctgcccggtctcggtctgctgcctgtaacgactgtgatgacaggcgagaaggttacacgtcgcacggcatttcgctttctggatcatacggatgaatgcgagggatatgagattcatatggggcggacgatgcctgtcgaaggtgcagcatcttctccactgaatcgactctcggatggaacagaggatggatatttcgtggatgctacttgtatgggtacttatgtgcatggtatcctggacaatccggccgtaatagactatctgctttcaccgtatgcagacaaaatggaagagcggaaaagcttcgactatgtccgctataaggatgagcaatacgataaattggccgaccatctgagacgatatgccgatgtcccgctgatttaccaactgatgaaagacgatgattaaaggacacggagatgacctctaccgtcacggccccattcgggcaaatttcagttcgaatgtttataacgccaccgagcgtcagggattgctggatcaccttcacaggagattggatagcatcggttcctatccggagccggagccttattctttggagaaaggtttggccgattatcacggtatagctgccgattcaatcagtgtgaccagcggtgccaccgaagctatttatctcatagcgcaggctttccgtggatcttcttcagccgtagtagttcccactttcagcgaatatgccgatgcttgccggctgcatggccatcgtgtggattttatttccaagcccgaagaggcttcttctcgatatgatatggtctggctctgtaatccgaacaatccgacgggacgtgtttggaagacaagcga

SEQ ID NO: 776 - DNA (genomic), 708 bp, PORYPHYROMONAS GINGIVALIS; double-stranded, circular
  misc_feature 1...708
  hypothetical: NO
  anti-sense: UNKNOWN
ctgcggatctgtcgttgccgaaagtcggtcgatgcacatccgacttgctaccggtgtagcaagcactcctcaagacgttggatgaaatggaaaagaccgctatcgagcaagccttggcacgaaacggcagcaacctttcgaatgtggcaagggaattaggcatcagccgccagactctgtataataagatgaaacgctacgggctgtagcccctcttctatgggaagacggaagaccggcagtttcggcttgcatctgttatttaccatcgtcatggcggtggtgggtacttggtcggcagctgcaggacattatgccatcactgtttttgcagccggactcgttatcttttccgccttgcggttgcgtttactttatcggcgccatcttcaagatctttccctgctcttgaatgctatcgagaatggcgattattccgtgcgcttttccgaaatgggaggcaatgtctcgcatcgaacattcaaccgcacgcttaatcgtatcaaggagatcctcagccgttctcgtgatgaggctatagccggcgagcagtttctcgtacatgtattggaacagattcctgtcggcatcatgatggttgctccggaaggatatgtctattctaccaatacagtgctgttgcgcctcctcgggttacccgttatcacacaccttcgatcagctaaacgtgtgtcgccggacatgcct

SEQ ID NO: 777 - DNA (genomic), 647 bp, PORYPHYROMONAS GINGIVALIS; double-stranded, circular
  misc_feature 1...647
  hypothetical: NO
  anti-sense: UNKNOWN
ggtaaattggaatttcattcacaatattacacaatctgcttaaagaaaacaagagaagagaccgcgccaacattttttatatgtttccttgccaagaaaagagagaactctacattcgaaatctctttgaagacatcctgttctgaatttttaggaatccgaaggccgtgtattatttttcactatatttgcaatacagaaagctgattaggaaggcgaattcgggcgatttttagcctgtaaccggttcctgatcagttttttctttatttggcatgtggtgttgagtccggatactttttgtcacttccatagcgttccggcaagcccttaccactctcctccctctttctaatttccactaaaaaacttgcaccaaaaaagttttcaacaacgaagacgagtttggaatgattccaaataagcatccaaaagggagaggcatccaaggtaaaaaaggatagaaaactgtcttcccaacttcgaaattcgttttcagaagagtcgaataacgatttgtatataaatgactttcaatttatatataaatggttttcgttttatatataaatcgttttcaataaatatatagatcgtaagtgattcgtatataaatcgcangctcgaaaaggccttttccgaagccg

SEQ ID NO: 778 - DNA (genomic), 3842 bp, PORYPHYROMONAS GINGIVALIS; double-stranded, circular
  misc_feature 1...3842
  hypothetical: NO
  anti-sense: UNKNOWN
gaatccancatctccctctggtcgagacagtagtagaaggcggtactctggtaatcaaaatgaagccatcgctatctatctctatcaataaaggtgtccggatcaggataactactccccaactgtcagaagcagagctacacggaagcggtgatattacatttgccggaaaattccgtctgcgatctcttaggatcgaactctccggaagcggtgacatcacttttgccaatgccacgatagccaatgatctgaacgtcagccttagaggtagtggcgacatacggggcaatatccttaccggcaggaatgcaactctctcgctggccggttcgggcgacatagacctttcgctcggtcatcctcagagagtggaagccggtatcagcggaagcggagatataaagataaagggacaaacagcctttgccgcgctgaaatgcagcggaagcggagacctcgaatgccgtaacctgtcggcccaacaagccgacgtaaggatcagtggcagcggagatggcaagctggctgttaccgaaaagctggatatcaacctatccggatcagccggctttgtctgctatggcaaacctgtcatcggtacacacaaagtcagccgttcttcctctttccgaatggttccttaaatccaacgacagcatagattagaacttttcatagacgcgagtagcaatagggcgagacattccatcagagagaatgtactcgcccttactacatttgagaaggaaaccggaggtcttatgcggcctccataaatgaattttgaaacagccccgcgatcaatcgtggatcctttcccccgactcaatttgtttgtatttcatctcggcataaaaatggaatttttaattgcatttataggtagggtgtgcaaatgcgcaatggtagtttttatgtttgggagaaagtcggaaaatagttacttttgtttttatgcataacgattgcttttgcccatttgatgggcgaaaacaaatatgatcacagtaaagacaatgaacgaattcaaaaaatacgcgacccgacatatcgggttgaatgcacaggccttggacgactataccagaatccaaagcagctacatctctccgaccattatcgaagaacgccagttgaacgttgcacaaatggatgtgttctcacgtctaatgatggatcggatcatcttccttggcactcagatcgacgattacacggccaatgtcattcaagcacagcttctttatcttgatagcgccgaccccggtaaagatatttccatctatctgaattcacccggcggatctgtttatgccggttatggcatatacgatacgatgcagtatatagggtgcgatgtggccactatctgtacgggcatggctgcgtctatggcatcagtgctgctcgtagcaggaacgaaaggcaaacgctttgctttgcctcattcccgcgtgatgatacatcagccgcttggtggtatgcaggggcaggccagcgatttggagatcgcagctcgcgagattctgcgcgtcaagaaagagctttacacgattatctcttctcacagtggaaagcccgtcgagcaggtcgaaaaagatagtgatcgggactattggatgacagcccccgaagcattggagtacgggatgatagataaaatcctcgaaaagaatcgaaagtagccctctcgttacccaaagggggactgtatatttctcatggcaaagaaaaaggacgaagaatactgtagtttttgtggcatgccgagaacgcaggtaaacctgatgctcgaaggagtccatgctcatatctgcgatgaatgtgctctccgtgcaggagaggtggttcgagaagcattgcaaaaattcaaatcggaagagacgaacaatctgaagagagaggacttgcctcggcctatagagatcaaggaatttctcgattcgtatgttatcgggcaggatgatgccaaacgttttctttctgtcgctgtatacaatcattacaaacgattgctccagcaagaggacagcgatggcgtagagatcgagaaaagcaatattattatggtcggtcccacgggaaccggcaagacactcttggctcgtacgatagccaaaatgctccatgttcctttcgccgtagtcgacgctacggtactgaccgaagccggctatgtgggggaagacattgagagtattctcaccagacttttgcaggccgcagactacgatgtcaaacaggccgagagagggattgtctttatcgatgagatagacaagatagcccgtaagagtgataatccttcgattacgcgtgatgtcagtggcgaaggagtacagcaaggtttgctcaaacttctggaaggttctatcgtaaatgttcctcctcaaggcggtcgcaaacatccggagcagaagatgattccggtggacacgaggcatattctcttcgtttgtgccggagctttcgacggcatagagaagaaaattgctcagcgactcaatactcgtgttgtgggttatactgccggattgcaaaacaggcatatcgatcgtgagaatatgcttcgctatattcgtccgcaggatttgaaatcttttgggctgattcctgaaatcatcggtcgtttgcctattttgacccatttggagccgttagatcgggatgcccttagaaacatcatgacggagcccaagaatgccattaccaagcaatacgaaaaactgtttgccatggatggcatcaaggtttcttttacatccgatatgcttgatttcgtcgttgataaagctatcgaattcaaactgggtgcacgcggactacgctccatcgtagagacgatcatgatggatgcgatgttcacgatgccatcaggtaagaagaagactttggtcgtagacaaagcttatgcagaagctcatttgaatattgacgatttgctacaagatcaataatagaagtacccccaagagaatctaaccccaaggagttgctacccggagtgtagtgtgacacctgtcaagtgttgtattatggacattgttctggccgaaaaattacagcagtattttggatttgaccgattcaaaggcaatcaggaggctatcataagaaatgtattagccgaacgaaacacttttgtgctgatgcctacgggaggtgggaaatccctatgctaccaattgccggccatgctcatgaccggcacgaccatcgtagtctctcctcttatcgctctgatgaagaatcaggtggatgccatgcgtagcttcagtgccaaggatggggtcgctcactttatgaattcttctttgaataagacacagctcgaacgtgttaagaatgatgtacgcgatggacttaccaaactgttgtacgtcgctcccgaatcattgacaaaagaagaaaacattgcttttctgcgtgaaatagatatttcgttttacgctatagacgaagcccattgcatatcggaatgggggcatgacttcaggcccgaatacagacggattcgtcctatcatcaatgagatagggccccgatcgatcatcgctttgacagccacggctaccccgaaagtgcagcatgatattcaaaagaatcttgggatgatggatgccgatgtattcaaatcgtctttcaatcgtcccaatcttttttatcatatacgtcctaaaacacaggacgtagatcgtgacgtagtcaaatacatcctatcccagccgggaaagagcggtattgtctattgcatgagtcgaaataaagtaactacttttgcccaggttttgcaggccaatgggatcaaagcccttccctatcatgcgggacttgacgcc

SEQ ID NO: 779 - DNA (genomic), 788 bp, PORYPHYROMONAS GINGIVALIS; double-stranded, circular
  misc_feature 1...788
  hypothetical: NO
  anti-sense: UNKNOWN
gtgtgacttccgacagaacagttgtgagcaatctgtacaaggttgtctagctttactccgcgatgtatgatcgttgaatccataacagccctgtcgatacaagtgttggcaccgatttcgacatcatcttcaatgataacgttccccagttgcggaatcttgctgtagccttcggcattcggagcaaaaccgaatccatccgctccgataacggctcccgaatgaatcacgcaacgcgaaccgatggaacagccatcatagaccgtcacatgggggtagaggatcgtcccctctccaacagacacaccgctacctacataaacatgcggatacaagctacagcctgtacccagcgatgccccttccgacacgtaggcaaaagctcctacatagcaatcatccggcagtatcaccgatggatgaacgaaagccgtggaatcgactcccttcctttggggcttcatgctgtccaccaactgcattagttgcgccaatgctgtataggcattgggaactcgtatcagggtcgtcttcaccgattcgcgcggttcgaagtcctgattgacgagtactgcatcggattgtgtttggtacaaatagtgttcgtacttagcattggctaaaaacgagagacagccactacgaccttcctctatcttggcaaaagtcgtgcagtcgcaccttgggattgccctccacagaaccgtggaggtagtcaagctatctggtgggctgtaaattccatgtgaccgggttaattagggtacaatggatcttaaaacattttt

SEQ ID NO: 780 - DNA (genomic), 491 bp, PORYPHYROMONAS GINGIVALIS; double-stranded, circular
  misc_feature 1...491
  hypothetical: NO
  anti-sense: UNKNOWN
gagagggaaaagtgctcagaacaagtaaaaaaatgaccgtcatagctatgcatgaatgaagaacggcaacctgtgttctctttcgttttttgatgagtataaggtaaaagcaaaatctttcgatatgggtcattttcgaagctgaaaaaaacggaatattcaccgaaaaatatgcgccaaaaaagttttcaacaacgaagaagtgtttggaatgattccaaataagcacttctgagagatcgaaattcgaggtaaagtacgtaacatgacagcctttttcagatcgaaaagctctttttattagttcgatgaacaatctatatattaatcatttttgatttatatataaatcgttttcattttgtatataaatgattttcaataaatatatagatcgaaaatgatttgtatataaatcacaacttcctaaaggctttttcttgagggataaacagaggcaccatcggattttctcttgaatcgacggtgcc

SEQ ID NO: 781 - DNA (genomic), 757 bp, PORYPHYROMONAS GINGIVALIS; double-stranded, circular
  misc_feature 1...757
  hypothetical: NO
  anti-sense: UNKNOWN
ggcgatgagttcgacttctccgtattggcactttatgatgaaaaacgcttatcagttgggaggaggcgtctataatgtgcagaaggaaaagttcaaactgaatgttttctatcagagtgatagtgcaggcgtctaccaaccatatatcagtgaaggcaagattaagggacagttgcttctgcgcgtgttgggcatggacagactggatgccaaacaagagccttaccctgatggtacgtacgactttgtcgatggctatacgatcctccctcagaaaggagttgtgatcctccctaccgtggagccgttcggaaagacccttgccgatgcgtttggcgatcctgtattggcgaaaaagtactgcttccaagagctatacgatacaacggcagtggctgcacagcaagtggcagagaagaacaaatttatcttccgaggcgaatacaaagcttctccgggcggagacatttctttgggagctatcaacgtaacacccggatccgtcgtagtgacggccggcggtgtcaagctgacggagaatgtcgattatacggtagactacctctccggcaacgtatcgatcatcaatgaagcgattctctcttcgggaactcccatcaatgtgtcgctcgagaaccgagggctgatgaatatgcagcgcaaaacgatgttcggtatagatctgaactacaacttttccaaagacttcaccctcggcggnaccttcatgcacctgagcgaaatgccgctgacgacc

SEQ ID NO: 782 - DNA (genomic), 653 bp, PORYPHYROMONAS GINGIVALIS; double-stranded, circular
  misc_feature 1...653
  hypothetical: NO
  anti-sense: UNKNOWN
tcatcatcttccaaatcatcgtcaacctgcgcgacagccttcgcaatatctccaaagagagctttcttgtccttacctcattgggagccactcatgctcaactgatgcgtcatctggtcctaccggccattactcccgaagcactctccacactacgagtggccattgggacagccatatcagtactcttcgtgacagagacatacgggacgaataaagggcatgggattcttcattgtcgatgcatggatgcgtatcagctatacggagatgtacgtgggcatcgtggttttagggatggcaggttttttcctttttttgctcgtggatggtcttgagaccgcactatgcagatggaggaacagttagccatacaatcaaagaaatcatcattcaacaaaacaataacgatcaagaaatgaaagtaaaacatctattagctgcatccttgatgatgctaggaacagggaatatttgcgcccaaaagtccgcaaacagtattttcaatgcaatcaaagaacgggttagcctcagtggttatgcgcaagcagggttttcctcttgtggcttccctacggcgagttccgaaaanggagaactacacacattcgatgtaaagcgtatcaaccttcgtgccatgtcgcatcacggac

SEQ ID NO: 783 - DNA (genomic), 587 bp, PORYPHYROMONAS GINGIVALIS; double-stranded, circular
  misc_feature 1...587
  hypothetical: NO
  anti-sense: UNKNOWN
tccaatcgtattccgcttcatcaaacgggttggcttgggcgcgaattaatttcttttcatggcatgtggggagatcttactccccataataagcccggatcggtcggtagttttctctttcccgaaaatactatccccatgaatcatacatggtacatggaagggagcataggtctggagaatatcttccggctcctgcgcatcgaatacttccgacgcttcacccaattacaaacgactccgaataaatggggagtccgtgctcgcttccagatcactttctgacctctaaaggaaagaggaaatgccgaaacttttcgttctgacatttcctcctcttcgaagcgattcttaatagaatcagagcttgatgaagcgttcggccggtgtgctgccttgagtcatgagtttgatcacataggccccggcggtcaaaaccttcacgccgatcatgcgagtattctccatagagagcaccaaacgacctgaaaaatcaaatatccggacaccgaagtcaccttcatgcttaatattcagtacatccttcaccggattggggtaaaccccggaatcagaagaaaaatagc

SEQ ID NO: 784 - DNA (genomic), 3722 bp, PORYPHYROMONAS GINGIVALIS; double-stranded, circular
  misc_feature 1...3722
  hypothetical: NO
  anti-sense: UNKNOWN
gcgatagaaatgttcgtcacctcgctacccgttccgcatgttgtgggcacaatgatcagttctttctctttgataagaggtattttgcggtcgaatgcatcgagtacatcatttaatcctttcagaacgaaaagtttagagatgtcaataaccgtacctcctccgataccgattacgcggtcgaactggatattacggatgtctgccaagatgttattcatcatttcgtcagaaggctcgccttgcccatatttctcctgcataacaaaatggcaggggagctggcatgccttcatatacggttcatagatgaactcgttggtaattaccaagtcgcgttctccaagacagaattccttggcaaattctgcaaaagtgtcaaagtgatgtgttacactcttgagtttgaaaagttgcataatagtattattggtttttggaataatcctaaactttttttcttctcttcttatccgaaacgtttgcggagatgtttcgttagttcctctctgaaatccgggtgggctatggcaataagagcttctgctcgctggcgcaaactctttcctttgagttgtgctataccgtattcggttacaacgtaatcgacttcgttgcggagggttgttacagcagctccctctgcaattataggtacaattcgagatgcagtaccgtttttggctgttgagggaattgccatgatgcttttgccgtttttagaccatgctgctccacgaacataatctacttgaccgccggttccgctgaattgcttgcttcctatacattcggacacgacttgtcccataagatcgatttcgatacagctattgatgctgaccatattatcattttgagcgattactcgcggatcattgacgtaatctaccggataaagttctacatcgggatttttgtcgatgaaatgatatacgtcttcgcttcccattaagaaggttgcgaccatctttccggggtgaagtgtctttttctttcctgtaattactccactgcgaactaattcgacaacaccatcggagaacatctcggtatggatccccagatcttttttgtccttgaggaataacagggctgcatcaggaatcgcgccgataccgagttggagtgtggcaccatcttcaataagctcggcacaattacgcccgatagcttcttctacttctccgattttgggctttgcaagagaatagatagggtagtctgccatcacgatgtaatccaacttcgatatgtgaatcaagttgtcgccatgtacatatggcatttgacggttgatttcccctataactaaatgagcgctttctgctgccggtttgctataatcgcaagatactccaaaactacagtaaccattctcatcaggcattgaaagctgaacgatggcgacatctatgtgaaggatgtctttgcgaatcattgatggcacttcataaaagaataccggaatgaagtcggctctattttcctcaactgctttacgagaattaccacctacaaaattggttatgtgtcggaagtgaggggccatttcaggtgccatatattttccttcgccgagacaaagcatgtgataaatttcgacattctggaaaaggtcggcctgttgtaccagtgcatcaacacaactctgaggaactccggcagcatgtgacaaagctacccgttctccatttttgatatgttttacggcttcttcggccgaaacaattcgggaggcatattccgctaatacgtctttcataaaagctatttgggttttctcaaaatattcttggcttgttctaacagatcatcgctaacactattttcaagaatgacatcgatgttgtcatctttgaagtattcgcgtatcatggcttgaacgattttttctactgtctcatgtgctgccggacagaatcggcatgctccggaaaaccgcacaaaaacggtcttatccttgatttgagataaagataagtcgcccccgtgactgcgcagtagcggactgatccgctcgcgcagtacgagttcgactatttcttctgtcattgtatccggtttcacggttgcgttataatccgtcttctaaatacatcaaacagataagtgaaggagagccgattacttatcgagtgattcgtcgatatgagcaatcgcccgtgcaagctttttcttgccctcaagatctccctgacgagcgatcatgattctctgagcttgaggagatccggctccgtgcatagactcggttcgataaccgacggcagctgttcccagcgtgatattctctatcaaacgcagaacacgcatacggttttctgtcgatttgcctgttgcacctgcaagatatttctttacgatcgggcctatttccggatggcggaagtcttgttgagaaggcatggttaccatcaaacctcctgcaatatcttctgccaaacgagctatttcataaggaaggcgggtgatattttgcttacaaacattagctaacaacaaatcgatcatatagttgccggctttcatctgagttccctctgaagagcatgcaataccgcaagcataaagggtttcattcaggtggatcatctcaatgagtttatccttaatgtgagatgccttaggaactccattgtagtctgctgcaagagcagctgcaccgataagtacatcaccaacacctactttacatcctccataagactgacggtggtatccggcgaaacgttctaccatcatacctgcaaactggtattctttgcacatgaacacgcgttcattgggcacgaatacgcggtcgaatacaacaagagcttcatgtccgccgaattcagagttgccgaggtcaatgtctgccccttcttccattttgcgagtgtcgcatgactggcgaccatagatcataataacgccttctgcatcactgggaacagcaaaagaaacggcataatcagcatcagcttcgcgcatagcgatcgtaggcatgatcagatgctcgtgcgaattgactgctccggtttggtgtgcctttgcaccggaaacgacgatcccatcttcacgaacttcaacaatgtgcagataaagatccggatcggcttgttctgagggagataaaccgcgatcccctttggggtctgtcatggctccatctacgaccaagtcgttgtcttgtacatatttcatgtactcgatgaaacgcttgtgataagtggtacccagagcttgatccatttcgtaagtagtagaatagatggcattgaatgcatccattcccacacaacgctggaagcatgaagctgttttttgtcccatgagacgctgcatcttcactttgtctttcagatcctctgtgctctgatgtagatggcagaaacgattcacttgcttaccagtcaagtttgaagttgctgtcattaaatgcttgtattcgtccatctctgcaagcttataagtcatagctactgaattcattgagggacgaatcatgggatgatctacagggttttcgatcctttcacccatgaagtaaaccttcagattaagtttccgaagactttctacgtactgttcgctagtcatcatagtttctttgctctttaagtgataaaactttcgctttatttctgtttttagtcgattctaatgtgtttcaggctcttcgaggaaaagttttagattccttgtaggccaggactggggttctttttctggtttac

SEQ ID NO: 785 - DNA (genomic), 749 bp, PORYPHYROMONAS GINGIVALIS; double-stranded, circular
  misc_feature 1...749
  hypothetical: NO
  anti-sense: UNKNOWN
gggcttccatttgggcatagtctgtatcacgcggagggcttccttgtcaagtgcagggtcaatacccttaacaacagttgcttgtgtcacagaaccatctttttcgaccacgaaacgaacgattaccttaccttggatgcccatttcggcagcctgctcgggatagaccaaatttttactaagccatttagagagagcagtataaccacccgggaactctgccggactttctaccacttcgtggattttgtcctcttcttcctcaactttaacgggggcaacgggcgcaggcgggggcaacggtttgctctcatcgacagagaccaaagcgattttctccactttctgggtgttatctaccaccttaaattcttccggcagctgtacctcctgttgctggggttgctccggctcgggctgctccggctccggctcgttttcttcgagcaggacagtttcctccatgtcggcaatatccactttatcgcgtgtataggcctctatcttatcgtaagtacgatattccaaagctacatacacgatcgcgagagctacgacaagccccaaaaggaagttcaaaccttttcccttctccaagtcggccttaggcgatttcttgatttccatatctgatagtattgnttttgatttcttgctttggggcaaaaatacaaagttttttcatncccaattcgttttgggtagaaaaaatcaggcgtatggggcaaaattgcaggctgcaaaaatca

SEQ ID NO: 786 - DNA (genomic), 3656 bp, PORYPHYROMONAS GINGIVALIS; double-stranded, circular
  misc_feature 1...3656
  hypothetical: NO
  anti-sense: UNKNOWN
cgtttttccgacttctgcagtttctccgaattgtaaatgcccacttcaantccattgctcccattatttttacttttgtttctaaaatagaatacgaattgacagagcacagttgcgaggtatgggggttgccctgattacccctttcgacgaaaagggcggggtagaccacgaatcgcttcgacttttagcggattatcaggtagcgggaggtgccaactacatcgtagtacttggcacaacgggtgaatcgcccaccatcgaggatgccgagcgctctgcgatattgcaaacagtcagagaggcggtggcaggacggtgtccgatcatcgttggagccggaggcaactacaccgaacgcctcgtcaatcggattcaagccatggacaagaccggtgtagatgccatcttatccgttgctccttactacaacaaacccacgcaagaaggcatttatagacattataggactttggccgaatctactgatacgtccatcatcctctacaatgtccccgggcgaacgggtgtgaatattaagtccgaaaccactctcagattggctacagactgtccgaatatcatcggcatcaaagaagcttcgggcaatgtggatcaagtgcgtgcaatagtgctggaaaaacccgatcctttcattgtcctatcaggcgacgatcatctctccctttcctttataaaggaaggagccgagggagttatttccgtgatcggaaatgcctatccggagcttttcagtcgtttgatacatctgtgtttggaaaaccgatttgaagaagccgaaaccatccaacaacgactggaaggaatgtactacctgatgtttgtcgatggtaatccggccggaatcaaggaattgctctatcaaaagggtctcatccgtcacaatatactaaggctgccgcttgtatctgcatcggactctacctctactttgattgccagagttcgcaatcagatcgaacagcggtaaaaaattttcagctttcgtccgtactgtcatgcccatcattccctctaaagtcctgtttgtaaccggaatagacacgaatatcgggaaaacctatgccacggcttttcttttcgacaagctctccgagtcagggcaaaaggtcatcacccaaaagctcgtacagacgggatgtgtaggtgcttcggaggatatagaagcacaccgtcgtctgaccggataccctacaatggaagaagatggtttgggacttacttgcccctatattttcagttatccggcttctcctcactttgcagccgagatagatggtaaaagggtggactgcaagataatagaccaagctactgaaactctcctctctcgtggctacgatcgcatccttctggaaggagccggcggactgatggtgcccatcaccaaggactatcttacagctgattttatagctgacagagattatcctattgcactcgtgacgagtggccgactggggagtatcaaccacacgctactcaatttggaattgtgccgacacagaggtattccggtcgaatccattgtctacaatctttatcctgccgaagacgaccgtattattgctaacacccttgattatctccgtttctatctgcataaatatcatcccgatacgcaacttatggtgatgccggaacggaattgattcggacacactacaacatattaggatcttatcccaaaacgaaaaagcctccgactctccctaacaaggtgagtcggaggctttttagtatccgttagctaaggcttacttcagcgtaccttgctgtgcttgttcgatcatcttggcattcggcaagatataaacctccacacggcggttggccgaacgtccggcaactgtgctattgtctgcaaccggttcatggctcccacgcccttcggctgccatgcgcgacatactcacaccctgagaattcaggaaagaatatacgctggctgcacgtctctcagacagaggatcgttgatcttgtcggagccggtattgtccgtatggcctacgatacgaatatccgtgtcggggtttttgttcatgtttgcagcaaacttcgtcagcgcagtgcgtgagttgggactcagagtgctggagttcgtcgcaaagaggataccgctatcgaaagtaaccagaatagcctctccgtcatttactgtctgaatcgtagcatcgggtactgcggcctccagttcttttttctgcttgtccatcttctttccgatgagagcaccggctgctccaccgactgcagtaccgacgatggcaccgacagccgtatttccggctacgttacctactccggcaccaatggcacctcctactccggcgccgataaggccgccttttgccatattgttcagtccgcaaccggcgaacacgagagccacggccaaaactgaggctactacacttgatttcttcattgtctcttcttttttattcgtttacacacgatgctttgttcacacaaagctatcccgtgaagggatcaattatctttattggcaaagtacttcataaactgcatacgctcgtacatcgttgccgacttcacgctcgctgcattgagcttgcctcggaattcactaaccgaataatagccctttacttgcatccagctctcaatggtggcgatcatttcggccacgaattgaggtccctttttgtaaagaaccgtacatatctgagtcacatgtgcaccggccagcaagcacttgagtgcggcctcaccatcatgaatacctgtggaagaagcgatggatatgcccggcaccaatgcactcacgataccggcatggcgaatcgtatctgatatttctcctgcagaggtaaatacgtctccggccaccatctgtactttgtcgatgtcgatgtcgggctggtatgagcgattgaaaagcaccacacccttggctcctgccgcacgcagcttatcgacgagagatgggatattggcaaaagatttggaaagcttcaccactacagggattctgatggctttgatcagagagctgataatatccacatacatctgttcggctttgttggcatcgaagaagagatcggtattgagtcgcatcacgttgatttcgagagcgtcggctccggcttcttcgaactgcttggcaaagtccacccacgaatcggagcggaagcagttgatgctggctattacggggatagccacctcgcgcttcacttcgcggaggaagtcgaggtgtttggagatctcgttgctctgtacataggcattgatatagtctgccgcctcaggataatccatcggggacatcatttgggacatttctgcctcgatctgctcttcgaacagtgatttcagtacgatggcagcaacacccgctgcttcgagatctttgatggttttgaggttgcgggtcagtcccgaacttgctgcaacaataggatttttcaggcgcaagccggcgaactcagtggacaaatcgatcatatctgtttattatgaattacgaaaaagaccctgcaagccttccccgatcactctcggccatctctgtttaagacagacgaaaaaacgccctcgacaacaaggcttcccagtgcctccggcacatatatgcgagatgcgggctacacagaaggtctattct

SEQ ID NO: 787 - DNA (genomic), 781 bp, PORYPHYROMONAS GINGIVALIS; double-stranded, circular
  misc_feature 1...781
  hypothetical: NO
  anti-sense: UNKNOWN
agcggattgtccttttatagatgtacgatcgtaaaaacttggaaataacgcactcgatctagcccatactaagaagaaagagcctcataggatcggcagtacgatcccatgaggccccaaaccggatatcggcaacggctaaaagcggtaacctatgcccacgaagaagtcacgattataagcgtattcgttatttcccttttctcttagagcggtcgtcgaagaggattgcctattgtcgttcagtcggggaatatcagaacctccacctgacacaatatccacaaatccatgttcatagcctatctgtatataataacgcttatagtggaatgcggctattatgtttgccccgatgtcccagcggatatttgttgggccaccaagcgttgggccaaaaaactctgtgctgtagttgttcggcttccatccttccaacttctgccgatatgtaccatatataccgtatgcaaggaaaggacccgcttcgatcgaaaccgccatgtcattcatcaggtcgaaccgcatgccggcattgatcggcagttgcagatagtgcaagcgagtggaaaccatcgtaatataggtaccaggaaccatttcgggtatatcccattcggttttggagcccttcatcgtatagttcagacccggagccaagtagaatcctcttgatccgatcatgaattcggcagcggcaccgacccgcaggccgacattcatttggtgtcccacacatatccgtctcttttcatgctctgattgctgcctacgaagttgg

SEQ ID NO: 788 - DNA (genomic), 934 bp, PORYPHYROMONAS GINGIVALIS; double-stranded, circular
  misc_feature 1...934
  hypothetical: NO
  anti-sense: UNKNOWN
tcgatacttttgtcagaaaaaatttcggccgagatcccgctccgtttgaccacatcggctgcttgttcgtacaaagattcgtattcggactcctgaagttcacggatgagggaaacgaactcaccaagacggcgtcgggctgtagcactaagatcgggaagacccttctgcgattcggacagtacgtcccacaacgaacgagaagaagccgtggctatctcgttaagacgagacagagtggtatctcctattcctcgcttgggataattgattacacgcctgagtgcttcgtcatcattgggatttacgattagacgaaaataggccaggacgtccttgatctcttttcgcgaatagaacgaaagcccaccgtatatacgaaaagggatattgtgtttgcgaagtgcttcctcgaaaactcggctctgcgcattagtgcggtacagaatggcgaaatcggaataaggacaatgctcttgcatgcgtcgctcgacgatcgaatccgctaccgtataagcctccaaataccccgacagacaacccgtcaggcgaatacgctcacctacttgtttgttcgaaaaaacttgcttggggattcgcccctcattgtgagcaatcaagctattggcagcattgacgatgctctgtgtactccgatagttctcctcaagtttgaaaagtttgctcccggggaacgactttgaaaagcccagagtgtttttccacttgggctccacggaaactgtatatactctgagcatcatcccccacgacgaataccttgcctttctcccccatcaactgcctggcaatcaaatactgtgcaaagttggtatcctgatattccgtcgatcaataaataatcgatgcggtcacggtaggtctgcaagacatccggaaaatcacgaaaaaggacattgttttgaaaagcaga

SEQ ID NO: 789 - DNA (genomic), 2118 bp, PORYPHYROMONAS GINGIVALIS; double-stranded, circular
  misc_feature 1...2118
  hypothetical: NO
  anti-sense: UNKNOWN
tcggagagagacgtttttccttcgaaaagataactgccatcccccaaaaccttaaaggggagttcttcctcatcgtactcgtccgtaatctcgccgacgatctcttcccaatatgtcctccattgtgatcagtccgcaagtgccaccgaactcatccacaacgatggagacatgcaccttattggctctgaactcctcgagcaaatcatctatgcgcttgttttcggggacaaaatatgctttacgaatcagaggatgccagtcgaattcatcgcctttatccatgtgtgggattagatctttgatgtaaatcacccctttgatattgtcttctgacccctctgaaacgggaagtctggaataacccgacgaaacaacgaagtcaagcatcttacgaaatggccagctcagatccacatccacaatatcgatacgcggaaccatgatttcgcaggctgtcttattatagaatttgatgatttcgttaatcatttctttctcctccggctctccctccgtagtggtgagggctaccgctttcgagagctcatccacggacatatcgtatttcttcttgctgatacctctggtaacgatgccggtacttttgaccagcaattttgaaaacggtgacaatatcttatagataacggacatagctgcagcagaaaagcgcgagtattgcagcggattcttccgcgcatacactttcggcagaatctctccgaacagcaaaagaacagtggtcaggagtatcgtctggatcagaaatccaatgatcggagaagagaaaacgaatgtctgctcgatggcataattggaaaggataacgatggctacattaatcacattattcccgatcagaatagtagctaatagctgattcgaattgtctaataaattggaaagcgcgatgtcggaagagtgattccgttcgcggatgttctgcagatcgatcggctttagtgaaaaataagccacctcacaggaggacataaaagccgaacagcaaagaagaagcaggtcgataatgaaagccactatggctgctgcaccgataggattgacccgaagcccttcaaaaaaatcagtaataaggtgtaagtccaaaataaatctgatttgggttagaacggaaggtcggacggaggttccgagctttcttcttttgccgtatcacggacggatgaagaagacgcgaggggcgtcgtatcttgagtcgatgaaggtgtctgtgaagttctgctttcgtctcgattggaggaaccgctttcaaaaaagttgattttctcggcaaggatttccgtcacttgccgacgaacccctgtattgtctacatacgtgcggtagcggatttttccttcgacatataggagactccctttcttgatccacttctcggcaaaaatggccaactcgcgataggcaaccacattatgccattccgttcgctccggcacttcagtgccattggccagcttgtagcctcgctcggaagtagccagcgaaaagtttgcgacagccgaattgctatcgaaataccgaatctcgggatccttgcccgtacggcctatcaagatgattttattcagagacatgagcaatttctaaccaagtgaacgaaacaaaaataggaaatatgattcgttcaagccaaatgctgccctgtctgcaacttgtgcatatccgatgggacggccgaacgcagcaagccaatcaactgttcacgaagtttccggcgagaataatcctgacgcacggccaaacgtacttcccttaccggacgaggcataccaaacggacgcaccagctctttctgcgaaggtgataattgctctacggtcagttgtggaataaacgtaattccctgaccgctctccaccaatcgcatgaatgcttccatgctaccgccggaatatgccgtctgacgttcatgcaaccctttcatctgacaaaaacgaacgagctgatctctgaagcaatgaccttcgtccaacagccagagacgatgtgggttgacctcggtagtgcgaattacatcttgttcgaatagcggctcacagcgcgatacataccccagaaactcctcataatagagcaagtcgtcttcaagacctt

SEQ ID NO: 790 - DNA (genomic), 3261 bp, PORYPHYROMONAS GINGIVALIS; double-stranded, circular
  misc_feature 1...3261
  hypothetical: NO
  anti-sense: UNKNOWN
tgcggacatgccttgtcggattcgtttcgggtgagtcccgatacgagtggattcatgaaaacgacatcgggacaataaaaggagattacatctacccaaccattatcggcgggtgcatctatgaattgtatcttgtagccggtgattttcttcagtagagcttccagccctgcacgaatcataggtagcggttccactatcgctaccttgagtgtgatgatattcataatccgttttccttttctattttacgaatcaaaggcacgaaaagatggtcttcgacaaagttgtgtgctgacaaatcgtcttccgaggagaatatgtcgtgcagaacgctgttgagttcgtagccactcgatgtcgggtagtatttgatcagcaggttcttaagttcggaaatcttcagctctatctgatcgtggcgtttgctgaatatatcgattctgtagtgcgaacgtttgtccaactttccgcccaaaagtttttccacataagggaaaaccgttttctcttcgtagctcatgtgcttgcgtacttcctccacatactcatcatagaattgacgaatgacgaataccacttcggatggacagttggacagtgcggccaaaaggtctttgaccggagcaaagggcagacgaaattcgagaaaataattatgcgactttcgcagatagttgatcagggaaggagctgacagatctgacaagacggtctcggaagggtgttcgggacggttgataagtgcattgattacagccatgagggtattggtgtttaccttattgtcctcacagacttctcgtatgctcttttctccgaaaccaagcgaaataccaaagcgcgtaatgaccagtagtaagtcgtaattctcgcatatcaagtcacttagctttgtattgggtgagtatgatttctttatgtgatgtgttgtcatacgaaaaaatattgttttgtttcaaacaaaagtatagttattccgcctaatcgacaatccccacatataggtatctgcttgaaatcaaatgatttcgcacttgatcgttctcttttcttatgctggttcggcttaaaccccttcaaagagggaatggcatttattcgtcagaatcctgtggagaggtctttgtctttcttttcgtcttcattgattttgtactgctctttagtcgcatatttatgagaataatccatacttttgcagcgaattttaatgaacccaactaacttaaagcaatacggaggtagtagaatgaagaacatcctgattatcggctctaccggacagatcggatcggagttgactatggagttgagaaagcgttatcctcagggaaacgttgtagcgggttatatccccggtgcagagcctaagggcgaactactcgaaagcggtcctgccgaaatagtagacatcaccaatgccaagcaaatagcagaagtggtggataagtataaagtagatacgatttacaatttggctgcccttctcagtgccgtagcagaagccaaacctcagttagcatggcatattggtctgggaggacttttcaatacactggaagtagctcgtgaaaagaattgtgcagtgtttacgcccagctctatcggtgctttcggcaatgatactcctaaggataagaccccccaggatactattcagcgtcccaagaccatgtacggagtaacgaaggtcagtggcgagcttttgagtgactactaccacaagcgtttcggtgtagatacacgttcggttcgtttccccggtttgatctccaacgtcaccctccccggtggtggaacgacggactatgccgtggatatttattatgcagctgtcaaagaaggacgcttcacttgtccgattaaagagggtacttatatggatatgatgtatatgcccgatgctcttcgtgcatgcgtggagctgatggaagctgaccctgcccgtctggtacatcgcaattcgttcaacatcactgccatgagtttcgaaccctcgcagatagcggcagcagtgaagaagctggtacctgattttgttatgaattacgaagtcgatcctcttcgtcaaggtattgccgaatcgtggccaaactcattggatgattcttgtgctcgtagtgaatgggattggaagccggattacgatctcgattccatgtctgcagatatgatccagatactgaaagctcgctacggcaagtaaacagtctttttagctgccgataccgacttctttcggatatatatcgatcggcaaaatactcatgatgggggctgtgtcaaaattcatttttgtcacagcccctatcttttcagtactcataatacgatgaagttccaactttcacaaactagggctttttttattcgccaatttcgagtaactcagtgcatatcaataaattaatgagagacctttgaaaaaagaggaggttatcaagaatcaccctttcagtgtcattttttcacagtaggatggtaactgtcgaggatgataaagctccccttatccatcggtccgacctcaaaaacaaggccggccggtgagtgttcgctcatccgagacacatttggatataatgagatagagattaaaggctatgcttttgaggatgtttcggtatgcgttttggcgaggcttcgataccgacaacgacctccattaaaccatcgatgcatgctgcctttgaatcaagtcaatatacttaatcttttggcgacgtattcggatactgatttatgtactgaaaaagctgatattcggaagggttagtttgtgatttggactacaaggatcttactaaactttatttttgagaaaaggcttgaaagttccaaacacattagctacttttgccggagtaatctcttactattatttagagttctctatgaagacccaagaaattatgacaatgctggaggctaagcaccccggcgaaagcgaattcctccaagcagtgaaggaagttcttctctctgtagaagaagtgtacaaccaacatcccgagttcgaaaagaacggtatcatcgagcgtatcgtagagccggatcgtgtattcacattccgtgtaccctgggtagatgaccaaggtaaggtacaggtaaacatcggctaccgcgttcagttcaacaatgccatcggtccgtacaagggcggtatccgtttccatccttcagtgaacctctctatcctgaagttcctcggtttcgaacagatgttcaagaatgcactcactactctcccatgggtgg

SEQ ID NO: 791 - DNA (genomic), 867 bp, PORYPHYROMONAS GINGIVALIS; double-stranded, circular
  misc_feature 1...867
  hypothetical: NO
  anti-sense: UNKNOWN
caggacctgccaaaagaaaagtttgccggcaaattatgctcggcaccatactctcggaaagaagaataggtagtagcaagcctatagtgggtggagggatcgtatatactgatggaaagaggtcgcctattgctaccgatttctgatatatattccatttttcggttgtcttgataggaaagcaaatgtcccttttgtgcaccggtcgaaagtaaaagatccgatgccacaatggaagcaccatcagctttgaatagctgtgcgaggaaaagcgattcgaaggcacgataggagagttcgataccggtgagttcgctaagctgcgaataagaggctgttacgtagcgtttgttaatggcatcagttactgtcataccttcgggtgtaatccatgcacgccctgccactacgagaggaaaaggcatggcaacgaggcggataccacgattgcgaacgagggtcaattcgatacgtgtattcacctccttttgatcgaatcggagaatagctttgcccgttgcactgaatctgtcctgtcgagggtagtgctccttgatattggcaaaaagagcagcagggctactgacttccatatcgttgccggcaccggatatggacccgaatgtatgggtggaaccgcatcctgcgacaagcaacgacacaaaaaagataacgacgataaatgaaatcccaagggggccaaacttcttcctaagcatcatttcttcttttctgggatatattttccttgttctattttcttgtctagcatgggactgcctcctccaccgatctctttggcccgtttccattccaacatagctttttctttctctccgagcatatagaggacatcgccatggtgct

SEQ ID NO: 792 - DNA (genomic), 1818 bp, PORYPHYROMONAS GINGIVALIS; double-stranded, circular
  misc_feature 1...1818
  hypothetical: NO
  anti-sense: UNKNOWN
ggttgatctcctttcttcgcaaaaaggacactaatactccctgctttaagaatccggaagaggtacagcacatttgtgtagggagccattcgtgtccgatgaaaattgattgaacatttcgtctctctttatctatctgttttggggatgttttatgatatagtttgataattgcacttattgtaaaagtattatgtcactttatgagtgggtaatctgtaatagtataataatatatgaaatgatggctttgagtggatgtttttcatgcagatcggaaagaattttttgttggacatcaatggcttgagataatctgtttgttagtaaatttcagcgtttttgtgtcggcgagcactgaaaaagtcaattcttagagaagtctgccgatattgttattggtgtcccgtatttttttttgcctcacaggtgcccgattccccccccccttttttgatcgaatatctgcactggcaatgtaaccttgtgcacaaagaatgtaataattccacagggcaatcgcatttgaaccgttacacacttatagatctaacgattgctacgctcggttatcaaacaagtacgaattaatgggacctttgcacaataagcaggcacttttgtttattcttcttattgtgtgtcaggcgactatttggtacacgccggatttccacaagtggaaagatagctttccaccggtggaaaataaactttccaccaatggaaaattctttttccaacggtggaaatctacttctctttaatgagtacccctttgagacatccaacgacatgaccgtcaacagcacttgtgctcctccaatcatcgccttgctccccgtgtatgcaccttgtgtgccacgctgtgccgtctgattcacattacgtccatacgagccgatacctcctccggctccaataatctatccggctaccgtcggtacacagtagcagccaacaataccaatgaggagaaacccgctcgaatgaaaccgcaaaaccaatttaatgcgtcgaccccgggggcagcctgtcagggcgatcgcgtttgaaaatttttagtctctttcctctatgatttgaatctctggcatatggattcgcacttgttttgataattgaatgtagcaatcgttaggtttataagtgtgttgacagttcaaatgcgattgccctgtatccgagaaataatgcagcaactatctctcggaaaaagcactacctttgtagtcattccaatttaattacgtagtaatcaagcagcaaattgcgtgtgatggaaaaggttatccgcagagctctcatatcggtctatcataaagaaggtttggccgagatactggccgaattgaacagacaaggggtagagttcgtatccacaggaggaactcatgaatttatcacttcgctcggttatgcgtgtcgggccgtggatgatctgacgcgttatccttcgatgctcgggggacgggtgaagacattacacccaatgatcttcggcggtattttggctcgtcgcggtcatgaaagcgatgtgcgagaagtaggcgagtacgggttacctcttatcgatttggtcatcgtggatctatatccattcgaggccaccgtggcatcaggagcatcggaagaagatatcattgagaagatagatataggcggtatctctctcattagaggagctgccaaaaacttcgaagatgtcgttatcatctcgtcacgggcacagtatgccggattttacagcctgctgaaagagcagggagctcgaacctctttggctgaacgggggatcctaagagtcgagtgcatgaa

SEQ ID NO: 793 - DNA (genomic), 637 bp, PORYPHYROMONAS GINGIVALIS; double-stranded, circular
  misc_feature 1...637
  hypothetical: NO
  anti-sense: UNKNOWN
gtatagccttgacggacgaatacgacacgaccgaatgagtcggcgatgatgacgatcggcagattggtcgcatcaggcaggttcgcagcctcccgtatcatggcggcattgcggccttgaatatccagtccgaatacggctgtctcgggcagggaggggaagtctgccggtttgtaacgcttgtgtccgtcggcatcggggaagaggaggatcagcttgcgcccccactgctcgaagtcggctttcaccttctccaaatctttcagagcatggttggtaggctcctgaccggctccgagtatggccatcgcgaagtagccgcgtcctgtggtagagaggagcgagcggtcttctgcatgggagagatcgtggtagagctgttcggcattgatggagccgatcacctgaatgtcggtcgaatcgtgtagcagttcgagcggttggcgagcagtcttaccggcttctaccgtgaacttcctcatccggcacaatacgctgccactggccatacgcgtaccggtaacgaggaaataatgacctgcattcatttccttggggcggtcgaagagcgtcttcaggtcagtcggttcattttcatcataatagagcgtgcggatgatgcccgaggtgtagctcg

SEQ ID NO: 794 - DNA (genomic), 3064 bp, PORYPHYROMONAS GINGIVALIS; double-stranded, circular
  misc_feature 1...3064
  hypothetical: NO
  anti-sense: UNKNOWN
aaggtcgctgttgctgaaaagcaatgtagcgattgctatagcaaataaccgatttcatcttcatttctgctgatatttttattggatttataccggtcacaatttgtttttacagaggtcaaatatagtcaaaagtgcctgatcggtggcctgagcgataacctcctcacgagtaccgctaagatgcagacagtgcgcgaaagtgtcctcaccgatgacaagagcgatccaaactgtgccgaccggcaccagatccgaaccgcccgaaggtccggctattcccgtagtcgcaattcctatattggcatcaagcagacggcaaacacccacagccatactgcgtgccacaggctcgctgactactgtatggctttcaatatcggcttgggacactcccaaaaggcgtattttgatgtcgttctgatatgccacgaccgaacctctgaaaaaagtcgaggttcccgggcaatgagttagagccgaagcaatagttcctccggtgcaactctcggcagtagccaatgtaaggcctcgctcagtcaagagcttcgccagttcggaaataacgggattatccatcagaccgtgatgcgcgagaatggaacagcatcgatggggcagaaatcgccctgcaagtacttatagtatccggaaatggctaccatagcagcattgtccgttgtataggcgaatttgggaatgaatacagtccagccataacgtcgggcatggtcatgaaaagcatcgcgcagtccggtattggccgatacaccgccggccaaggccacttgtttgatgctatgatctttggccgcttggcgaagtttcttcatcaagatgtctatgaccgtgtgctgaagagatgcgcacagatcggccttgttcttttctatgaagtcgggatcttcggccagtttgtcgcgcagagtatagaggaatgatgtcttgagtccgctgaagctatagtcgtaaccggacacatgaggacgggcaaagcggaaagcatcggggttgccctcggaagccaacttattgacgatggggcctccgggataacccaaccccatcaccttggcacatttgtcgaaagcctctccggctgcatcgtcgatcgtctgtcctattacctccatatcgtaaggggagcgaaccagaataatctgagagttgccccctgaaaccaacaagcacaggaatgggaaagagggatgctgtgactcctcacccggctcacgaaggaagttggccaggacatgggcatgaagatgatgacttccagcatcggaatgcccaatgaaagagacaatcccttggcaaagctggtgcctacaaggagcgatcccagcaaacccggtccacgagtgaaagcgatggcatcaatttcttctttgcgaatgccggcacgtttgatagcttcgctgactaccgggacaatgttctgctgatgcgcacgcgatgccagttcgggaaccactcccccgtaggctttgtgtacggcctgtcccgcgatcacgttgctaagcatagtttcgttcctgaccacggctgcagaggtgtcgtcacaggagctttcgatccccaatatgataatgtctttcttcattgctgtctttttttctatctgcaaaaaaacgaataaaaccttgtttgagccaattcttcctccgagtgttgctgttttcaattgtgataaggtactgccatgagaaaacaaggagaataatggaatggaacagacatccgaaccatgggagatacctctcttagaggaaattccggcctcttctcagttgagtatagacagcaaaacgactaaggctgtgtcataaagggggtaatcctttgacacagccttcgtatgggaactgctattcgttctgcgtgtagcccataggggaatcgaacccctctttcaagaatgaaaatcttgcgtcctaaccgatagacgaatgggccaaaccgagcctgacactcgtctccgcttcgcagacaagtacgagcagagggagagagccttcccttacgctaatgtattgatgcggcgagcgagctttgacttcagattggcggctttattcttgtgaataatattcttgccggccaagcgatcaagcatcgatgccaatacggggtatttcttttcagcttcagtacggtccgtcagtgcacggaacgctttcactgcattacgagccgtacgggcatagtaacgattgtgcagtctgcgtgcatttgtctgacgaattcgcttctctgatgaaatatgatttgccatatccttctcttgtgataattttaattctgtagcccataggggagtcgaacccctctttcaagaatgaaaatcttgcgtcctaaccgatagacgaatgggcctccggatgttcttagcaaaagacaaaaatccgttttgcgtttgcaaaggtagtattaaatctgaaattgccaaacgattttgcttctgcaccacgtaagtttcggtgcttttgtctcttcattttccattgcctcctccaagagctccacacaagatatagtccgaagaggcttcttggtattcttaaagagtgcgatcggtcagaaaaagacgaaccgcaaatcagaagaaagtggttccggaaatcctgaaaacacgcgcgaaaaaaatttcgttttggttcgggaacaaaaaaattctcgaaccaaaacgaaaaaattctcagaccacgttttgcggagctatactcggcaaaatttacgaacgaaaaagcgtgcaagatgagtatgccccctctcgctgattttgtatcggaggtggtagagagttttgtcagagggcttggccatctaaaccaaacggcttgagcacagaggactgaggtcggtggaaaattgccttactttttgggtatagccacgccaccggattcggcgaagaaaggatctgcaaatggatggtttcgcaggatcgtttagcttacgggttcgaagtcgagttgctttctgtccagattggcttgggcaacacgtacggtgatggcatcgcccagactgtagcggtgacgatagcgacgcccgatgaggc

SEQ ID NO: 795 - DNA (genomic), 579 bp, PORYPHYROMONAS GINGIVALIS; double-stranded, circular
  misc_feature 1...579
  hypothetical: NO
  anti-sense: UNKNOWN
gctccttacgctttaatttggtttgcaaaaatagtaaatatccttagtaatcggaaaaatacaatcgctcctctctcgatctttcctcgcgggatgagaggaaggtagagagaagagcgactgcagcgggaataatctctgtcgggtgcgcgcggcctataatcgagatcttgtatccccggtccttatagttctacttcgaaggtccggatattaccgtccggataaaacccacgcacgatgatcaagcgacccgatcggctctgtccggcctcacgaacgatgtcgctgacatcggcacccgagcttaccggttggcggttgatcgaaaggatgatgaatcctttcttgatacctgcatccttgaatttccccgagcttacagaggttacctctacaccataagaaacaccataggatcgcatttgttcggcactgagggtctttgaatgatgctcccaatacatttccggtcgattcgnccggtgattaccgaagtacttccttcattgttctttgagcgtgacngtcagttccttggtcgcttccttacgattgatggtcagcttcactttgtct

SEQ ID NO: 796 - DNA (genomic), 934 bp, PORYPHYROMONAS GINGIVALIS; double-stranded, circular
  misc_feature 1...934
  hypothetical: NO
  anti-sense: UNKNOWN
aagaggccgtattgggaagatgaaacggtgtttgcgaaaccaaagaagacggccatgctacctttatgccctatgctacaacagcattgtgcaggctgatgagcggtatcagaaaccttggcttactccttcgcaggcagaatttttatctctgaacggcttgtggtattttcgctattttcccgatgcccgtactgcccgtaccgattttgtcgaagatctgttcgatgtgtctgcatgggataccatcacagtaccatcgtgctggcagatgaaaggttgggatacacctttatatatcaatgtaaaccacatctttgaggacaatcctccatttattcgcattcagaagacttatacctcggcagtggatcccaatccgacaggctcttatcggcgtgactttatccttccgacaggctgggaaaagaaacgcgtttatctgcatttcgatggtctctatagtggggcttatgtatggataaacgggcgttatatcggctacactcaagggggcaataacgatgccgagttcgatatcagtgcggcagttcgtgcgggacagaacaatgtgagcatacaagtagtccgctggacggatgcttcttatttggagggacaggatatgttccatatgagcggattgcatcgcgatgtctatctgtacgccacgcctcgtacttccattcgggatcattacataacgagcaagttgcatcccgaatccgactataccacaggggaaatatccgtagccgtcgagatggacaacagagacggttcggctgcacgtaagactgtcggaatacgtctcttggatccccaagggaaagtgctctgggaggaacggaagcaaacccgactgtctgtgggagaacagaaacaaagccttcattttcggaaagccgatcttcgcaatctatccctgtggaca

SEQ ID NO: 797 - DNA (genomic), 908 bp, PORYPHYROMONAS GINGIVALIS; double-stranded, circular
  misc_feature 1...908
  hypothetical: NO
  anti-sense: UNKNOWN
gtaaaaggtatgagcatgaaagaagccgctctggaggtgaaccactggtgccacgagaaagctacatacagccccagcgacccacgcactcgctctccgcttgcaacggtgaagaatgctctcggacgttgcggtgaggagtccaccttcacggtggctgccctgcgctcggtaggtattcctgccagacaggtctatacgccgcgctgggcacatacggacgacaaccacgcatgggtggaggtatgggtagatggcaaatggtacttcatcggagcctgcgaacctgcagccgagctgaacgatgcatggttcaacagctccgttgtccgcgccatgctgacgcatacgcgggtcttcggtcgttacgaaggtccggaagagaagttgttccgcacggccaactacacggagatcaactgtatcgacaactatgccccgacggaaatgatcgaagtcaaagtcaccgaccgctccggtgctgtggtggaaggggccgatattcgtttctgcatctacaactattcggagttctatcccgtggtgacgaagcaatccgatgctcaaggactggcttccctgcgtgtaggcaaaggcgacatgctcatttgggcagccaaggacggactcttcggttatgccctgtccaaggccgacgatcgcaaaccgctggccatcgcactggacaacttcgaagcacagcccgaatgggccgatttcaaaatcgtaccacctgcaggagatcccatccctactacctgctctccacagcagatcagcacgaacgacgcccgtctcctgcgtgaggattccattcgggcagcctatgaagccacattcgccacagccgagcagtctgcagcactggctgccgaattgggtgtggatgcgcctgcgctgacaggcat

SEQ ID NO: 798 - DNA (genomic), 1537 bp, PORYPHYROMONAS GINGIVALIS; double-stranded, circular
  misc_feature 1...1537
  hypothetical: NO
  anti-sense: UNKNOWN
acgacgtactggccaatatagaagagcgcgacaggatcgactccacacgtgccgtttcacctttgagacaggctgaggatgctttagtgctggacaattctcatatgaccattccgcagcagaaggcatggttgctggagcgttttcaggaagtgaccggttcatgattccaatagaaatagacagcggatcgggattttgcttcggtgtggtgaatgctattcgtcatgccgagaaagcaattggagaaaaagctccgataagctttactgcctgggcgatattgtacacaatacgctggaggtcgaacggttaggaaagaaaggattggagacgatcgattacgatgctttttcccgactgcgtggggcaaaggtactgttgcgtgcccatggagaacctcccgaaatctatcggatggcaggagaaaatggggtaacgatcatagatgccacctgtcctgttgtactccgcttgcaaaacaaaatcaaatcacgatacgaagctacgcgcagcctcggcgcacaagtcgtcatctatggcaaaagagggcatgcggaagtaaacggtctggtcgggcagaccgaaggaacggctatcgtcatagagagcgaggaggagctggacaaaatagattacacacgtcctgtcattctcttttcccaaacgaccaagagcctggagggattcgggcagatcatcgacagcatcagcacacgtatgcagccgggtgtaactttcgagcatcacgataccatctgtcgccaagtggccaatcgaatcccgcatatcggagctttcgccactgcacacgaactggtgttcttcgtagccggagagaaaagctccaacgggaaggtactcttcgggcattgtctggcagccaatccgcgcagtatctttatttcctccccggaggtcatcgtgccggatatgctggttcctctgccggccagcataggcatctgcggagccacctctacgccccgatggcagatggaagaggtggcatcgcacatcaaggctctattgtaaactcggccgccaccggcaagtggtcgctatatcctcctttataatgcatcccctgataggtgcgattgggtgcgatacgcgccacattgtacggagcggagtgtaccaaataaggcaggactacattcttggccgatccggttcggtagctgacccgtgaatccggcttcaggaaattgcccgacacgatgatgtgatccaactgctcccacttacccttatacagagttgtcccgggagggatctgagagagaggacagcccgagaggttgtacaactcccctgctccggctttgccggcttcgggcagaaccgtaccggcccgtaaggtctcgatcagaggggattcgtccggattgctgttcaggtctcccatgatcaggatgaagggattgtgccggcggcttagtatctcattgcatttcgttctcagcagagtggcggcatcgtgccgataggcatccgattggcgcacacctcctctgcgagaggggaagtggcg

SEQ ID NO: 799 - DNA (genomic), 3532 bp, PORYPHYROMONAS GINGIVALIS; double-stranded, circular
  misc_feature 1...3532
  hypothetical: NO
  anti-sense: UNKNOWN
ttgacgtgtactgaaaaaagttgacagttgggcgggatgcaaccagtatccattatgggcaaacatttaaacaactttgaacgccttagcatccttgaggattacctctcggggtcagatagcaaagtagccattgagcagaaatatggtctaagtcatggtctcattcgctcttggcttagtaaatttggactcgaagataaagttcatccggtcccaatgaaagtgtcccaatccccccagagtgagctacccctgaatgaaaaagaagagttagagcagctacgtaaagaaaatcgtgtcctcaagagtcgtctcaagcgagaagaactagggcatcaagcctacaagctacttgtagagttggcagaagaaacctacggcattcagatacgaaaaaactccgaagccaagtagttcaccgtttatcagagccggagcctaggtatcctattgctcgactctgcgaactgcttggctttagccgtcaggccttttataaacgtcatctcaacgatttagcacaacatgaggaggatgtcctatgcagtagtatcatccaatattgttggcacttaagacaagcagagcacctacctcaagccggcttccgagagctcatggtgctttgtcagcaatacttcggccccaagttcacgcttgggcgcgatcgcttttgcgccctactcagacgccatggtatgatgctgcgcaaacggtctgtgcgccctcggacaaccaactctcggcataggctctacaagtatgaagacctgctcaatacagagcctaagtttgtgcctcaaagacctggggaactccttgtagcagacatcacctacgtggcttaccaagatgggtttgcctatctctccctactgaccgatgcctatagtcgctgtatcgtagggtattgcttacatccgaccctggaagttgaaggctgtttgaatgctctgcatcaagcctttgctttctacgatcaacatcaaattgatacgaccaatatgattcatcatagcgaccgaggcattcagtatgccggtaagagttacaccgatctgttgcatgggcgaggctggcgcatcagcatgactcagacgggagatcctctgcataatgcattggctgagcggatgaacaatacgctcaagaactcgtggcacatctcctcttcgaagcagtcttttgatcaagcactcctttctgtagaacaagccgtgcgcatgtacaacgaggcgcgtccacatcaagctctaggggcgaaaacgcctatgcaagtcattgcgccagagtctaaaaatccgttactggcaaggatcgaacattggccggagattgcccccgagctataccgaaggatgaatgtcagacaaagagctaactttgctcgtgtcaaccgaaattagacttaagggtaaggggtgtcaacctaaagtagaattatagaaagaaccagtaaaccaattgtagaactatcccgcccaactgtcaacttttttcagtacacgtcaagcacaattgcggatcgaaaaaagatggttcgagaaaaaaataaaactcgagccaaaagcaaaaaaatctcgcgcgtaaagattttccttgtggttcgagtttttgagattttaggctcggtaattctccgtctttcggcaccaaaaacaacatacgacttttctcagtacacgtcacaatcaagggaaagtcgggaaggatcagtcgcccggatagggatctgcagaaggaggaggcgtatcgactccccatagtttgttggggcgcggtcccatcttcagctccaaaatgccgccttgggctatgtcgctatgttggaaccatgctttatccaaggttttcccgttgagcacggccttttggatgtatttgttttcagctccggcaccgttggcgatgatcgtaaggtggttgcctccaccgagatcgatcgttatcttgctgaaaaaaggactaccgatcacatagaccggtaaacccggtgtgacgggatagaatcccatcatcgaaaagacggcgaacgcactcagccctccaccatcttcgtctccggggactcccatcagatcgtttcggaaccattcgtttacaagctcatggatcaacttctgcgttcgccatggctgaccggcatagacatataaatagggtatatgcaggctcggctcattggccatggaaaactgtcctacattgcctgtctggtcgggcagcttggaataaaaattgaacttccatgtactcatcggtgtgcggaaagtctgatccaagaaactgacaaactgttccggcccatccatcaaggcaatcagatcatggaggttgtgctgtacatcccagcgataagtgtaagcattgttctcgtcataatagtctcgtgcacccgggcctccatcaaattcgtaatcgaagggctgtatgaagcgtcccttctcatccttgggatgaaagaatcccgtctccgaattgtaaagatgtcggtagtcgtagctcctacgcagaaattcacgcgcttcgtgctcgtggccggagaactgtgccaatcggctaaggcaccaataatcgtaagcaatagcaagcgtaacggctactgcctgccgcttctcccaagagtgtatggtagggtcggtttccttttggtcctgtggcaatgcggggtagtagcctttctcatcgaaaaattgatcgagtgtgcctttgggcatacgccgccaaggtgcgtacgtcttctcggccatcacttttttggctaccgtatacgcctcattcaaattgaaacccgtaagacctttggcataggcatcggcaagcatggctatagcatgattgccattcatacgatggctgtcgcctgtcacttccgggaaggtaggcaaccatttctccctgctaagcaaagccatacgaatgtaggaattgaccatgtcggattccatctccggctccaaaagaatacgcaggggatgtacagcccgataggtgtcccacacccaatcgtctgtatagaaaggaatgcccctatccggatgcacagcatgatcttcggcactgtagaaatgaccatcctccgagatattgatcatccgttcatatgtacgataaaggctggtgtagaatacctgtcgctgaagaatcgtacctccctcgatctgcactttgcccagtgttttgttccattcgttccgtcccatcttggacaccacttccacgttgtaagcctgtatttcctgacgaagattctttttggcttgtgccacactgatataggaaataccatagcgaaggaagagatccgttccggccagatcgtagttcagcacgagagttttgcccgttaccttgcccttattccagatgtactcgcctttttccgaacggcgagcgtacgtcacaggctgctgctccgtctccatatagacaaatactcgcgtactgtcctgaagatagcgatagccggatatgacattaccttcggcagtcaattcccctttctcagagtgaacaacgaggtaatgcc

SEQ ID NO: 800 - DNA (genomic), 399 bp, PORYPHYROMONAS GINGIVALIS; double-stranded, circular
  misc_feature 1...399
  hypothetical: NO
  anti-sense: UNKNOWN
tcgactctnnaggatcccctgataattgatggaaaattccacatttcttgcagaaatttacacntatggtaactttttgataattatagtcttacaccccgctctttttggatggtcatctcatttcttctaaacctatttattgatactttctcccatttctccttgaaccacgcagcaatcggaactctgtccacgagcaggtcaagcacggtcttgccatccctttcctccctgcccaccttcaagcgtaccttctcaacggtgaacgaacgcttgtactcatccgaaaacagttttcccgtaacgacaaggacttttccctgtagcagttcatcagtatgtctctcggataatccgaccgaacggcaaatcctttctattctgaggaactcggca

SEQ ID NO: 801 - DNA (genomic), 700 bp, PORYPHYROMONAS GINGIVALIS; double-stranded, circular
  misc_feature 1...700
  hypothetical: NO
  anti-sense: UNKNOWN
acagccgctgcatagacaggaccggccagacagccgcgaccggcttcgtcgcaaccgcattcacgcaagtcatcgtctatgtagcgagagagcagcatggggaagaaattagaacatgcttactacacgtttcaaggcttggaggaattgctccacttcctcctcggtattgtagagagcaaaggaggcgcgagccgtggcattgagtcccatgctttcgagtagcggttcggcacagtgatgtccggtacggatggctatacccagccgatcgagcagcatgccgaggtcatagggatgaatgtcccctataaggaaagagagcacaccgctcttgtgttcggcttctccgatgatacgggcattggggaaagctctcacgccttcggtggccatgcgcaggagtttgtcttcatgtgcggctatggcttccaaacccaatccttcgatgtagtcgagagctgtggccaaagccgtggagccgacatagtccggcgtgccggcttcgaacttatagggcaattcgttgtaagtggtcttttcgaatgtcaccttggcgatcatctctccgccaccgtggtaggggggatcttcttcaaccactncgctttgccatcaatacgcctattcctgtggtgccgtagactttatggccggagaaggcgtagaaatccgttccaacttccgacatctaccggca

SEQ ID NO: 802 - DNA (genomic), 728 bp, PORYPHYROMONAS GINGIVALIS; double-stranded, circular
  misc_feature 1...728
  hypothetical: NO
  anti-sense: UNKNOWN
aaatccactacgtattcttctgtaatgcaaatgccgtttacacgaatacgctcgcgaaaatccaccaaatgaggagatgtaaacaagcctacccgcataccggcaacttgtaagatagcagccagtgtagaggcggtagagcctttgccgttagtaccggccacatgtatcgttcggtaagccttgtggggatgtcccagcacgcggtctatggtctctacggtaccgagcccgggtttatatgcactgcccccttggtgttggaagacaggggtagcggtaaagagataccggatagcttcttcgtaagtcatcatgcctgccggatgatggtctgctctcggtcggggccaacggaaacgatagcgataccgactcccaattctttttccaagaaggcgatatagtcgctaaattctttggggaaatcagcctcggaaaccacatttgtcattgactgctgccaaccggggagttccttgtaaacgggcgttaccccttctgtcagatggaaggggaaattgcgtgtctccttgccgtctatctcgtatgccacgcaagccttgatcgtggggaaaagatccatgacatcgcttttcatcatgatcagcttggtcacaccattcaacataatggtgtagcgcaaggctacgaggtctatccagccgcaccggcgtttgcgtcccgtcacagagccgaattcgcgttccaacttacagagcttggct

SEQ ID NO: 803 - DNA (genomic), 6091 bp, PORYPHYROMONAS GINGIVALIS; double-stranded, circular
  misc_feature 1...6091
  hypothetical: NO
  anti-sense: UNKNOWN
gctgaaaaaggccgattcgggaggtgataaaacaaaggcacccaccagttctatagggaactcgatgggtgccttgactctttgaggaggctatggaagcgttattcctctttatttgtcatagggatattcttgctttgtccgaacaaggcggggcggtatgacggatacgggcgggatggaaccggcctgatgagccggggagtatatgtggcatattcattgttatttggtcgtaaactgtttgtcaatatcgttctatatcaatcctataagcacttttagcaaagagttttatactctcgataggagcattcttggccggcaaatatagtaaaaaccatcaaccatggggaatcgaatttcacatcgcaaatcttctccacttcggtcggctcagggactatttgtttccagaagaattttcactgtcaggaaaaaagaatcggattatttccgtccgattatttggtcgttatggaattattactacttttgcgcctgggtaagtcctatacggcatgctccctttgattcccccagggcttgatcgcagcaagggtattaggtcgtagcggcgcgatatagccagcttacccatccgcctctttagctcagttggccagagcacgtgatttgtaatctcggggtcgttggttcgaatccgacaagaggctcgaaaagcattgcaccgattctctcagcttggtatgagaagtcggtgcagtctttttttactgttcctaatcttttcaacaccttggttccgttccggatttctaaagggctgaaaggaaaatcgcagtttttattgccttcgtttgttgcggataatccttatttttgtatccatttaagggataataaagttcatgtcaaggaaaaaccatacccactatctgttgctctggatgacagctctccttctgatcgtatgtttgcctctggagggccaacggaatcgcgcgtttaccgtggttatcgatgcccggacacggaggacatgattcgggggcagtcggtaatggtttacgagagaaagacatcaatttggccgtggctttgcgtgtgggacgactgatcaagagcaagcatccggatgtgaaagtgctttatacccgtgagaaggatttcttcgttaccctgatgggacgtgccgaatatgccaataaaaacaatgccgacctttttatcagtattcatgtcaattcgcaagagcgaggtcatggaggctatggtaccgagacctatgtaatgggacatgaacgtaacagtaaaaatatggcggtagtccagcgtgagaatgccgtcatattgatggagaaagactataggaccgtttataaagggtttgacccccgttcgtccgagagttatatcatgttcgaactgatgcagaatacgtatcaggatcagagcatcaaactggcccaacagatccaaaaaggatttgtggccaaggggcgtcatgataggggggtgaagctcggcaatttggctgtactcgtgttttctgccatgccgagcgttctcgtcgagctgggctttataagcaatccggcggaggctcgttatttggggtcggaagccgggcgtgacgaattggcttcggctatcgcccgaggatttgcccgatacaaagaggattatgacagacgttccggtaaggtgtccgagcccgcaccacaagctaccgaggaagaggataaggttgaagtcgaaccagaagacaatggtatttcttcggtggcagatatgtctgacggcaaggaaagtatagctcccaaggggcatgctgtaaagccggatgagggtgctcattccgcgaagaaaacctataaaatacagatcctgtcttccacgacgaagctcaaaaatggcgataagcgattgaaaggttacaaggtggtcattgaacaacgaggcggtcgattcttttatcttacaggagcggtttccagcgaggatgaggctcgtcaccttcggaaaaaagtcaggaaaagtttccctgatgcttatatcgtggtttatgaagcgggcaaacgtgtgagagagatatattgaaattgtcggaaagcattacttagaggtaacaataaaagaaatgagaataagtaagactacaaagatcggagcattgactctcattgctctttttctgctgtacttcggcctgaactacctgaaaggattcaacgttttcaaacgggcgaatgtgtattacgccgctttccctgaagtgaagaacgtcaacattgccagtcccgtattggtcaatggctataaggtaggagtggtaaagtctcttagtttcgactataagaatggtcgttctatcgttgtgggtattgacctcgagtccgaatatcgtatgcccaaaggtagccatttggccattcaccagacagctttgagtggagcggagcttcgcatcatacaaggcgatcctcgggatggatacctgaatcccggggataccattcggtctgaaactcccgatgatattatgtcggtaacttcgaataagatcgttccttctgtcgtgaacatgatgccgaaggtggattcagtcattgtcggcctggcgaatatggtcaataatcccaatttggccgtaatgatggagaatatggccgcaacggctcagcggctaaatcgtttgactgcttctttggacaagtccatcgggacgcaattgcctgccgtcatggccaatacacgtaccattacggataatgtggcaatgctttcggaagaattgaaacagttgaaactggaggctctgatggccgaattacaggctacatcagagaatcttcgaagcttttccgatcaaattcgcaattccaacggttcgctcgggatgctcttaaacgacaaatcgctctacatgcgactggatagtatggcttcgagtgcggatgcactattgcgcgacctcaaagccaatcccaaacgctatgtacacttctccgttttttgatcgtatgtgagagagatgagtatagcatttagcagatatattggtatgatgagacgaatttttctccccttcttgctttttctcctcttattgcactctattggctgtaagcagggtacaaagtcgggagcggggcagttgcttgcattgatgcacgaggcatacgagcatgccgattattccggagttcggattttggcagacagtctccatcgtcattactccaccgatacagtggctcgtaaggaggctttgtctcttagccggcaggccgagtacaaagaatgcgaacgcaatctcgccttcgccgatagtgctttgcttgttctctccgatcggatcgacagcatgtcccatcctttcagtaagacttcctctgtggagggaaggtctcctgaattctatctctcgggtttcggtgaggcttccggtcaggaacatactcgtttgcgttgcagtacggacacgcttggcaatctcattgtgctgagtgtttatgccggagccgaggctatcaatcatactgctatccgagtgacggatatgcagaccaagtccatgctacagactcgcgacattccctatgatgctgcacttaactatcgatttgccgatttggggttgcattacgaaatagtgacctatcctgtcgaagagacggtaaaaatgggtgagctttttattcaggccgattccgagggacatgctcttcggatagatttgatggccggaggcaaagcgatgcatacattccaagtatcgaagaccggtgtgaaatccttgtctgagaccgctcgtctgtcacaaatgtacagctatcgtactactctcatgggagagagagaaaaggcagaaaagcgtatccgttatttgagcgacaaacttggtttatcttcccgatagaggtcggctatttttcctcatcaattatttcaaacactatcatgtctgaaacgttttcggttcggttcgtccgcttattgcggcagaatatgaacgttgtttttctcatactcggtatcgtagtcttgtccttattatatccattggtgaaagactggcaggttttcgacccgaaaaaggccatgccacctttcttcgtgtggatttttgtcatcgttatgggtggaatgactgttgctacgggcgtcagaacggtctttctaacagattctactatcttccgcaagctgctggttatctcgtttgttgttgctgcggtaggccaactgctgggctttgccatcggagcgatatggcttttctgtggtatttcctatgtgtatgctattgctcaaaagaaattctatctgccggtaggtattcttgttctattggtagcttactatctgtttcagatgacggggcttatcggagctgtagagactaaagacgctctgcatacacttaagcagcgacttcccttattggctttgccgttagctttgtgctgttggcgtccgacaagaacggaatggggcgtatttctttctttttctttccgccttgtattggtgtacttatcctgcatcattgttgtctctttgcttctgaatcagtactatggccaatccattttgtctccgttttcttttgataaattctatctgaagactcatattccgacattggcatcgagtttctgtatgctccattggacgcattttgcccatcccacttatatcttcttgggcatattcgctatttttatggcagtcgccgtacgtcagtatttctatcgggagcaaacggtatctacggtggaaatgatctatggtttggttgccttgtcatgctttgcttttattacccaaagccgcttggccatgctcttcattcccctgtccatcatgttcttttttttggtgcgagcctttttcctatctcagaagaaaaaacttttgttcacctctttcatgcttatcatcgtaggcggttttatcttcaacggcctcttgtctcatcgtttttttgcggacggagagcgcatgcagatgcgtgatatagccatggatgccatcaatcggcatccatggacaggtattcggttaggcactatggacaatatattgcaggcgcagatcgatacggatattttgttgaagcatccgcacaaccagcttctggccgatggtatgcagcttggtattcccgggatggttgttttggttgtattcgtaggcggtttgttttattttgcctatcgcgatcgccgatatgatttcctccttttcctacctgctatcctcctgacaatggcagtcgaatcccctctgatcttcgttcgaggtgcctatttgttggcattttggttctcggtatttgccgtttctccgactcgaaagaaagactttgcttgaaagaattttttaagtttgccctgatcctcagatgatcagagtttgtttccgtatggcttgaaaaatgaaaaagcaaaaacagggaaaattattttattccatcagcgaagtggcgcggatgttcgatctgccggattccactctgcgtttttgggagaaggagtttccggcattaaagccacgtacttccgaaggcggcacacgtcgctatacagccaaggacatcgaaatggtgcggctcatccaccaccttaccaaggaaaaaggactcacacttgcaggcacgaagcaagctctcaagaacgactatgatggtactacgcgcagggaagaagtcatcagtcgtctgaaagaaatccgtcaggaactatgtgatatccgtgatgccatcgaccaatgggagcggaaaaatatgtactgaaggaaaaacgatgctgcgatggatcccgaattcgatcttcttctgaaagcctggaaaagcagcggactctctgtcggtatgaaagacgatgagctcttagccctgcttgagagttgttcatacagagtggaacggctgaaagccgaagagctatatgctatcggtggagacaagctccaagacctgcgaatcgtgggtgtaggtgagattcgtgctgagatggtggggccttccggcaagcagattctgatagatactttggcggtcggacgcatcttggctccggcccttcttttgcttcggagaatattttacccgttaccctgt

SEQ ID NO: 804 - DNA (genomic), 6401 bp, PORYPHYROMONAS GINGIVALIS; double-stranded, circular
  misc_feature 1...6401
  hypothetical: NO
  anti-sense: UNKNOWN
aggctaaagcagagcagtcgggagaagtgcatatcccgaggagagatctttaagaaggtaaagaagagcatcagaaagatcatgtagggtatcagaaaagaaagcggcgacagtataggccatgccaatacccccaaagccatggcaatgggtagtgccagatttttgaggatcttcatcgattttgattcttttttcgggctaaccatcgccccacagcctggtgtatggattccaatccgaagtcttcaggggttatatcgtccggagccaatatcaccaattcggctgcatcatcacttgctatggctgaggaaaaatcagaaacttgagctgcaaaaaacaaatcggccgtatggacgcgcatccctccgtagggatagatattgggaagcgagaaaagataagatactgcttcgacttctattcctgtctcctcacggatctctctgatgataccctcttctgccgtttcgtccatgtccataaagccgccgggcaaatcgagtgtgcctttggccggatctttggctcggcgcacggccaatagtctgcccgcgctatcggtaatgaaacaagccgtcgcagcagaaggattggcataataaatcaatccgcacttcggacacgatttggctttcgggtttctctccgcaaaaccatcgtttccgcagcgcggacagtatctgaaaggtgcgagcggatgctcagcgtttattttgcctcccatcccaaagcacttgccccgagcacagcggcatcgctctctttgagctgagagaagagcagcttggtcttccctcggtagatattcagcacattcttttccatgtggtggcggatcggattcatcagcaggtcacctgctttggtaagaccaccgaagaggatgatcgcttccggactggagaaggtaacgaagtcggcaaaagcctctccgaggatggctcccgtagtctcgaatatctcttgagcaaggccatcgccactgatagctgcatcgtaaacatctttcgaagtgattagatcgggctgaatgttccggagcaagctcttgtccgaacggatgtccaggtattcgcgagctgtacgggctactcctgtagcagaggtgtaagtctcgagacagccctatctgccacaaccgcacatgcgaccattgcggcgaacgatcatgtgtcccagctcaccggcaaatccatcgtgtccgtacaccaagctgccattgactactatgccgcttccgacccccgtaccgagcgtgataacgatgaagtccttcatgccacgagctgctccataggtcatctctccgatggcagcagcattggcatcattggtcagtgtcgtggggatacctaatgaatcggtgagcatttgggcgaagggtatttgggtctgtttccaaggcaaattgggcgcaaactcgatcgatccggtataatagtttccattgggagcacctacaccgataccctttatcttctctttccctcctacctgttcaatcaactgattgatgccggcagtcagatctttgatataatcgttcagatcgttgtgcgctccggtcttgatggacgaacttataaccaaattgccacgagcgtccaccactccgaatacggtgttggtaccgcctacatccactcctaatacataaggcttttccattgaaatagtgtcttttagatgtttcactttagctatatccgcaaagatattcgttttttcgtccgttcgttcaccggccggctggtatgctttgcagtttgctcctccggccactgatgacgatgtccagccacgaatacagtttgttccctccataatagaataagagtcccgaaaccagaccggccaatacatcgatgaaataatgtgcttgtatatagacagtcgccagtgtcaggcaaataccgatgggcaggaggtaccagaataacttccggctacttcggtgaaagaaagcgaagatcaccgttgtaatgccgacatgactactgggaaaagccgcagtgggacgctctcccatttgttgtgacatattgaccagacgatagaacagtccctgatgcgccacctccatctcttgtagctccgggtgtgcggcaaagtactgaccgatgggtggaaatcgccctgccgctacgctatcccaaccgatggcggggaaatagaattgtggcccggctaccggcaggagagtatagatcagatagtagatataaaaagaaccgaacagcacgaaagctacacgttcggcctgcctgtaattggagatatagtagaaaagaatgactccgacgataagtgcgtaatagatgaagtagccgaagtggaggacttcgcttattatccagtgggggaataaccggctaaaccaaatagccggctgactgaagcaaacgatctgttcggcctgagcgaagatatgatccagattgtcgaaatgctgattgaagagaaaagtctccggataccaatagctgagcagcatcagctgaaagatgatgcgcagtgcccaagtgaatcgagaaggagagcgataatagagcaatgcgaatatgcctgttcctacgagtatttccacccgattgagaagcagtgtgtcggcgtcgggcatggtggggcgcataataaggaggatgatccccgtgatgatgacgtaaagcaaagccaacacctctgtgaggatcagtagccgattggcataggcttgccctacggtggcagagatcgtcactgctttcctccgctgtttctgctgtcgtttcatgagggttgagactggtggcgtatatagaggtcttcgatgataccatctgccaatcctacgataggagcaatgatggttttggctccggtaatgtccgccacctcaaggaaaatctctgctgccgggatgattacatccgcgcggtcgggtttgaggtggaagcgtaccattcgttcttcggttgaaatgggcttgagcaggtcgtatgtcttgtgcagtgcttctaccggcatgatgctatagcgagaagaccccctgtccgatccgctcagacggacaaggcgattgatattgcctcccgtgccgataatcgtgatgtcggtatattcttttgtaatggccatgagttccgagcggaatgcttctcgaacataggggcgaaccttttcgctgagcagacgtaccgtaccgatgtcgaacgactgcgaatgcttgatatgggtatcggagaaaagtgtaagctcggtactacctccaccgacgtccagatagatgtaattgcctccgtcggaaataatctgttcgatatgattgtccgaaacgaggcgtgcctcctcatctccatcaatgatgtctatatggatacctgttttctctcggatctgtgcgatcacggcttcggcattcgatgcatctctcatggcggaggtggcacaggcgcgatagtcctttacccgatatatctgcatcatctcatagtatgcccgcatgagccgtaccatgttgtctgtcttttcctctcctatgtatcctttggtaaaagagtcttcgcccagacgaatgggaactcgcatgatcagcaccttgctgagaggctcctccattccttcgctattgacacatttgatcagtaggcgcacagcattcgagccgacgtctatggcggcataatgtaccttttccattctttaacgcttagtcaggcaaagatagtcgttagcattcattcccacatccatccctccgcatggtataaagtcaaacgaaaagggctgcgcgaacaggagtctctcctcctcgcacagccccgtttcatatttcgctaaaggggtcagcgacgcggtttgatgtcgagcttgaccggcttgatcatattctccggtgagagtatcgtatccagatcctctttcgacaggatgtcgtgttccaaaacgaggtcgtaaacgccacgtcccgtttccatcgcttccttggcgatcttggtcgaattcttatagccgatgatcggattcagagccgtaacgataccgatgctgttgcggatatacccacggcattcgtcctcgttggccgtgatgccatcgatacagagtgtacgcagcgtatcgaatccgttcatgagcagatccgaactttcgaagcagcattgtgccatcacaggctccatagcgttcagctccatttgggctgcatcgcctgccatcgttacggtcaggtcgttgcccatcaccttatagcagatctgattcattacttccggaatcacaggattcaccttacccggcatgatggacgaacccggctgcatggcaggcagattgaattcgtgcaaaccgcaacgaggaccgctggcaaggagacgcaggtcgttgcaaatcttgttcaccttcacacagatacggcgcaaggcagacgaatatcctaccatcacggaagtgtcgctcgttgcccctaccagatcggcactgagacgaatgtcccagccggtgacttcacgaagagcctctatgcagtattcggcatagttcggctgggcgcagatacccgtgccgatagccgtagcacccatattcacggtcaggaactcttcggcggcaaagtccagatttttgatttcatcctgcaagatggaagcaaatccgccgaacgtctgtcccagagacataggcacagcatcttcgagctgagtacgtcccatcttgagtacatgggcaaattcgcggctcttggcacgcagcgactcgatgagatccagaagatgggggcggaacttcagatatgtagcgtaaaggccgaggtggatagctgtcggataagcatcgttggtgctctgcgagcagttcacgtgatcattgggggagaggtgggcaaattcgcctgcctcgtgtcccatgatctgcaaggcacggttgcaaatcacctcgttggcgttcatattcgtggtcgttcctgcaccgccttggatcatatccacggggaaatgctcgtggtgcttgccttcgaggatttccttgcaggctttcacgatgccgtctttctgggcatcggtcaagagaccgagccgatgattggccactgcagccgcccatttcgtcatggccaagccattgataaacagggggtaatcgttcagatgaaaattgctgatggggaagttttctataccacgcagcgtctgtacgccatatagaatatggccgggtatctcgcgttctccgataagatcgctttcgatacgtgtagtcttttttaattccataaaaggggaatagtatttgattcttttttatagttgcacaaagatacaagttatttatgtacagccaagagagggatgctgcgactcttgttatggaaggaggagttcgccggttggggacataatgtcgggatttctaagaggagcgaatcagcctcgtttcctcctcgatcatatttctttcggttcctgacaggaccttcctacaatatgtgtaatcggccgataagacggttacttgcaggctcaatccctgatcgctgcccgtatgcgcatcagcttcgtgagcagcccttcgagcaaatccagtcggagcatgttggctccatcgcttttggccgaagcaggatcgggatgcgtttcgatgaaaagcccgtccgcacctacggctatggcagccttcgcgatggtctctatcagttcgggttttccccccgtcacgccactaccctgattgggttgctggagggagtgagtcacgtccattactacgggaaagcccagcgaacgcattgccggaatattccggtagtccaccaccaaatccgtgtagccgaaggtattgccacgctcggtcagaatcacttggctgttgccgctgtccacgcactttcgtgccacgaaagccatggcttcgccgagaggaactgccctttcttcacattgacgattcgcccggtgtaggcttgccgccacgatcagatccgtctgccggcagaggaaagccggtatctggagtacatccacgtactcggcagccatagccgcttcgtgtgtctcatgtatgtccgtcaccgtcgggacaccgaactcccggcctaccttgcccagaatgcgaagtgccttttcgtcgcctatgccggtgaaggaatctatacgcgagcggttggccttgcggtacgatcccttgaatatatacggaatgcccagtcgggaagtcacctctactattcgctctgcaatgcgcagtgccatatcttcgctctctatggcacaggggccggccatcaggaagaatgagtccgctgtctgtagtctctcgtataaggagttggagttggtcatcgtttcgaagttatttatcgtttctgtcagccaaaagtacaaaaagcccttccttaatcaatagagagtagtcgattc

SEQ ID NO: 805 - DNA (genomic), 2310 bp, PORYPHYROMONAS GINGIVALIS; double-stranded, circular
  misc_feature 1...2310
  hypothetical: NO
  anti-sense: UNKNOWN
gactcgttcctgccaagggctttcgagcagaaggcggatgctttcggccgctacggcacacgccaacggattgcccatgaacgtggggccgtgcatgaagcagccggcttcgcccgaacatatcgtccgggctatcgcttcggttgtgatcgtagccgagagggtcatatagccgccggtcaatgacttgccaagacacagaatatccggcaccgtggcagcgtgccggagcgcaaacagttcgcccgtgcggccgaatccggtagctatctcatcgaatatcagcagtacgccggcttcggagcagagtctgcgagcttcgacgagataccggggatagtagaaatacataccgccggctccctgcacgatgggttcgaggatgagggctgccagctccgccccctttgccgagaggaggtctcggagcggctctatgtccgccggcagccattcgccaccgaagcgactcttcggttgtggcaggaaatactgtacgggcaatgctcccgagaaaatgccgtgcataccggtaacgggatcgcatacgctcatggcgtgccaggtatcgccgtggtagcccgaacggatcgtagcgaatcgggtacgtctgctctgtccgcaggcttgctgatactgcaaagccattttcatggctacctccactgccaccgaaccgctgtcggcatagaagattttattcaactcggacggcaggatgctcagaagcagttcggccaattctacggccgggcgatgggtgaaaccgccgaacatgatatggctcatctcccgaagctgccgttctacggcggcattcagtcgcggatggttatagccgtgtatggctgcccaccacgaactcataccgtcgatcagttcgcggccgtcttccagatagatgcgtactccctcggcccgcttcacgggaaatacgggcaatggatctatagtcgatgtatagggatgccaaaggtggttgcgatccaaacgcagcatttcgtcaatggtcatagcttacctcccagtctgtatcgttagtcacttgaaatccgcattccctcacgagctgcatatcctcagcggctttgcttcccgtcgtggtgaggagatcgcccgtgatggctgcattgatacctatatatatagctttgcgctgaacggcagggcttagttgtgcccgtcctcccgaaaagcgaagaaaagctcgaggattgatgagccggaacagtgccacagtcgtgaggtattcctcttcgcttagaggcagagtcctctccagcggagtgccggggatcggctgcaggatattgatcgggatggagtagacattgatgctgtgcaggtagaaagcaaattcgatccgctgctccatcgtctcccccatgccgatgattccgccactgcatacacgcattcccacacggcgtgcagctcgaatggtggcgagcttttcgtcctgcgtgtgcgtactgcacagggaggggaagaaactcggagccgtctccatattgcagtggtaggtggtcaccccgttgtcgaataatatctgcagtttctcctccgagagcagccctaaagaggcgcagcatttgatgtccgttcgttgcttgatggcacgataactttcggccatctgtcgtatctcgttcatagacgcagtgcgcccgctggccacaagagaaaagcgtccgatgccttgccgcctgttgtaagcggcctgctcggcacaaaccgcggccgaaagaagtccgtatttctctatcgaagcggcataatggcggctttgagcacaccatttacagtcttcgggacagttgccgctcttggcgttgatgatggagcaggtgtcgaacttatcgcccatgaaataccgggtgatccgatgtgcagcctcgtagagtgcttccttatcggcagaggaggccagcagaagggcttcctcaagggttagttcgccaccgtttatcagtctgttttcgatcgtctgaatcatatatgggaacggagcagatcctttcctgtctgcatccgcgacaaaagtagaaagaagctccggcaatagaaactaatcggcccacagccacgacgctattatcgttcaagcaaaaaacgacagaggctgccccatcgagatgagacagcctccaggaagcgtcggccttaacagacgtatattacttcgctacccgctccagccacttaaccatggagagcataacgagcatggacaatgcacatgcacaggtaaatacaatccatgtagcagagatagaaagcgattcgtacagaatcatacccacgaacagg

SEQ ID NO: 806 - DNA (genomic), 2204 bp, PORYPHYROMONAS GINGIVALIS; double-stranded, circular
  misc_feature 1...2204
  hypothetical: NO
  anti-sense: UNKNOWN
ttgcctcgcaataccagcgtcttgaacacctgcctgacatcctcgcccagctgctctgccacatggacggccgagaggtctctctcgtccggctcgtaggggatcagttcgtacgttatatgcgccgcatccagaaggcgcgccacattggtcttgggcatctttccggtcatttccggcgaaaacgattgaggataaaacggataacggcatagccgaagcccaccacaaagagccatccgagtacagaatcccagaccttagtcccttcgtgtccgattttcatcagcccgaaggcaacgaaagtcagacatatcagcaaggcactccacgagccgtttctgtccatgaagcctgcataacgcatagccgtggcccgatcgatacgcccatgtttgtggccgataaagacggcactctgctctgccagagcgaaacaaaatgccacggctccactgatatggaagaaaagctccaaaccggcaggtctgccttccgagttgaaatcctccagtagcatgccggtgaaagcagctgcgaaaatcaggatccccaaccaatagagatagaaacggggcctcaacccttgcctcttgtcggatcgagttttttcgtgagatggttccttcatagcttctcgtatgacaatattcggttcgatttgtttaataccaacgcctcccgtgggtatcatgccctgcgagacgatagccctgcgactcttataagatcaattcggtcagagagccgaagggagggagtgaggcaaaggcactctccagcgtgcattgtccgaccagcgtacgggcacaattgatcaccccgccatggcagaagatcaggatggagcgataaccggcagctttcttttccaggatgaagtcccgcacgcgttcgaactgctctcgttgcgattcgccgccggatacgggttcgtctatgtagcggcggaaaaatgcttctatgtctgtcgtgtccagaatttcttcccagggtttgccttcccagtcgccgaagttcatctccttcagccggtcgtctcggatggcatcgggatagccgcaaaaggccgccaacttggccgcacgctgcagagggctggtaaagaccgcctcgggatcgaggcctttgagacgggcacaagccgccgcagcctcctcttcgaaggtgtctcgaacgtccacatcggtgaatccgtagcagtgctcattgccattgaacagcaccgaggtgtggcgcatcagatatattttcatcagtggattattagggtatcggtcagaaaaaagccttccgaatccgacaaagatagtagaaagagagtgcatctgaaaacagatcattcgaggattatcgatcaactgaaaaggcaggagttgttttgcgttttggttcgggaaattacctgatcagcattcgtaaaaacgtggcgcgagaattttttcgttttggcgcgagaattaaaattttttggaaccacagcgaaaaaaatctcgcgccgttttctcaggatttacagaccacaatccgagcattttcggttcgtaattcatcgaagagacaggttttacctgaaatcagagagagaatatccgtagtccaacggttcatccttatatcagaggttaaaagatatggtacgctcatcgaggagctgattggcttagtaggtgagactttcttaagagacctatcggcacctacaggaagttcatggcacacaaggcaaaggaggcaatcttcgcagaccggactcatatcaaaaggatgaaacgacttttccatacgacaaccaaatagccgtctacggtagacgaatgcaaacccaatatgaggccatcaatcaatccgaatgacagcttttgggcaatatattatgcatattttgattcgcgtttaaaggaaaagtgcatatatttgcgattgtggtatttctttcggtttctatgtgaattttgtctcccaagaagactttataatgcataaatacagaaggggtactacacagtaaaatcatattctaatttcatcaaaatgaaaaacttgaacaagtttgtttcgattgctctttgctcttccttattaggaggaatggcatttgcgcagcagacagagttgggacgcaatccgaatgtgagattgctcgaatccactcagcaatcggtgacaaaggttcagttccgtatggacaacctcaagttcac

SEQ ID NO: 807 - DNA (genomic), 3770 bp, PORYPHYROMONAS GINGIVALIS; double-stranded, circular
  misc_feature 1...3770
  hypothetical: NO
  anti-sense: UNKNOWN
gcagagcgtttctatcctctgtgaatgcgatcgcagcgtttcggaagagatagtctgaccgttgctacccaagaaccagaagctatagcatctgtctcttcgatcaagcatcgttcgcgcagatatacgaccgatatgacgaggtcatagatgtcgttctgcccgatcagcgaaaaagcggagaaaaaaaatcgacgatcaacagccggtagagactgttgcatgggagtttcattgaactcttttgctgcagagctgattcttagtgcctttgggaaagatcaaacctccggtatatggacatcgagcaaacagaaatttccccaagtttccattagagaagtactcctttcctcgtcaaataggcgagaaataagaaacgattgtcggctgtttcttgctccctgcacgatgcaggacgcgattgtcagctgattcttgctccctgcacgatgcaggacgcgattgtcagctgattcttgctccctgcacgatgcaggacgcgattgtcagctgattcttgcttcctgcacgatgcaggacgcgattgtcagctgattctgctcccatcaatgcgctaactatcagctatttgcaactattttataggactttcattgaagtcttttgccgcagagctgattcttaagtgtttttcaggaaagatcaaacctcaagatatggctaccaagcaaacagaaatttccccaagtttccatcagaggtatacttgagctttgaagagattgcatgaaatacttcctttcttcgtcaaatcaatgcttgtgtctgtcttgatcgatatgaggaggtggaaggttattgtgcaacggtctccggtaaggagaagccgttcgaaagacctcttgcaaataccgactgcaaaccgccgattatacgattataattatagccttaggccaggaagtaaaccatcagacctacgaccaccacatagaagagagcataaggaatggcagaacggaggatgctgccttcctcgccctgttggttgcaagatgccgtagcaatggcaatgctctgtggcgaaatgatctttcctcccgtagctcctgccgtattggctgcagccagccactgggcatccacaccgatctgatgagctactcctgcctgcaacttgccgaagaggatattggacgaagtatcgctacctgtgacaaaggttcctacggcacctatgagcggagcaaacaggggatagagcgttccggtggcctcggccaatgccgtagcgatgacaagtatcattccgctataagtcatgatggcactcattgctacaagactgatgatggtgacaccgcttttcctcagcccgataatggttttccccaaaatggcgaatagctttccggctgaaactccctgtaccaagcctccgataaaagctccgaggaagagcataagacctgcattgctaagccagccgaaattgaacgtcttaccatcatggtagataggcagagctatttttgataccaaattggacttgaggaaatcgcttacgggaccactcaccgggctggccagcacaatgaagaatagaataaagagatagacgctccatgcttcgaaaatctgcttgccgctgtacttctcaagagccacagacgtatctgcagctttcttggccgtcaatttggcaaaggtgataatgacgattatagcgacaatactaccgaatatagccggcgtttctgctcccagatagcgtgccgaagcatactgcactgccaaagaaactcctcctaccagcaaggcaagaatgatattcttgggctggctcttggcactcctgtccgtcaggaaaagaatgatgtatggaatgatgaacatcagcacagaaagttggagtacaacgtgtgcactgatggcctgaatctctccggctgtggccgcaccgttggccgctatctcattggccaatgtcgttacaggtactcctactgcaccgaaacccgtagctacactattggctatcagactgaccaatgcggagaacccgggtttaaatcccagactgataaggatggctgccggtatagctactgccgtaccaaaaccggccattccttcaaggagacctccgaatccccatacaagcaataggacttggatgcttttgtcctggcttatgccggtaaattgtttcttgatgatctcgattttaccggattcgagtagtacattatagctgtatatagccatcaaaatgataatcaaaatagggaagatagccttgagggcaccttccacaaaagcccatccgacacctgtccgggtaaaatctgtaggggcaaatccgagggcaggagctgcgaataaagctaccaatgctgcacaaacaagtgccagaacagcactcttgtcacccgccatcctaagcccaagcatcaaaacgatgaggagaacgatgggtagaatcgagagaataacatccatgatcgattgtttttagtgtgtattgagattgatatctacgcaaagaaaataaaaaaccattgccctcgcatcatttaatgacatccgatataatctttgaggacaggaatgtaatagctcccgaaatagataaagacaatgtgattcggccaactatttatccaataaaatagtgataggaaaaaggcatatacaaacgtccacaaggcgtagtgagaagacgtacgcctgcatgagtcgatcccgaatatggctgttttcattgaaaactctatctttgcgcatgggagtattaataactcaaacagaaaaaaagatgaataagatggttgttttggcagccgccatagctatgacggttgcattcggctcatgcaaatccaagcaaagtgcctaccgccaagcttacgagcaggccaaagaacgtgagattgcccaagctgaagacaaggatatggaaactcgtccgatagtttctaaaccggctaccaatgtacaaatccgtcaagaaaagctctctgcttacagtggggaagatgcttctcgattggatcggttcagtgtagtggtaggcagcttccgcaatgcaacgaatgctcgttctctgaaagaacgcttggaatctgaaggttatacccctattttggcagaaaacgaacaggggatgctacgtgtgatcgtagccagcttcccttcacgcgaagaggccatcgctgcccgtgaggccgtcaaggaacgctatgctccgaattttcaggatgcatggctgcttgagcgtgctaactaatggacatcagacaagactatccactctccaagcgcaatacattcggtattgcagcccggacagattggtggattgactacacatgcgacgccgatattgatcggttggtgaaagacgaattctttcaagattgtcgcgtacaaactattggcgaggggagcaatctgctcttcctcgctaattttcatggtatactgcttcattccgaagtaaagggtatcaccgaactgcacaaggatcaggacagcattcttttgcgtgtagggtcgggtatggtatgggacgacttcgtcgcttatgccgtggagaataactattatggtatagagaacctctctctcattccgggccaagtgggagcatcggctgtccaaaacatcggagcctatggagtagaagtatctcagctgatcgaggcggttcatgctcgtcattaccgaacaggagaatcccgtgtatttcgcaatgaggactgcagatacgcatacagatacagtatcttcaaagaacccggact

SEQ ID NO: 808 - DNA (genomic), 3662 bp, PORYPHYROMONAS GINGIVALIS; double-stranded, circular
  misc_feature 1...3662
  hypothetical: NO
  anti-sense: UNKNOWN
gaaaaactccaaaatgctcgttatccaaaccaattaatcgggcgaatcatttagaatctcacacatagggcattttataaagagggtgtgtcagaacgtaagttggacacaccctcttctcttgtttcagaaaggtagaggtgcggttttcagcggataggttcgagtggttctgtaaaggtggatatgtttgtatcacaggctgtagaactgcataccgcggcctctgctgttttgccccttctcctttcttccggcacttcgggtttggccgcatcctcaagtactcattccgttttttccatgataaaacatctttttatcgatcttgacgatacgctttgggacacttatcataataataagagtagcctcgaagagttgtatcatacacatgcctgggatagatatttcgactcgttcgaaactttcttcagtatatatttgcctcacaatgaagccctttggtctgagtatcggtatgggcaaatcgataagccgacccttactttggagcgtttcagaagacctttcaccggatatctcactttgtctgatgaacaaatactagcatggaatgcagagtttctgtccattaccgggcggaaaactcgactttgccctcatgctctggaagtgatggagtatctgcaccgttactacaaggtttatatccttagcaacggctttcgagaaatccagcatgccaaactgaccaatagtggtttggcaccctatattgaccgagtgattctatccgaagatgcgggtatcaacaagccaaacaaaaagatattcgacttcgcactcgtcaaagccaaagccagaaagacggaaagcatcatgataggagatagctgggaagccgatatagtcggggcggccaatgccggtctggcatctgtctggtataacccgaacagacatatcttacctgatgacggtgtacgagcacccatgcatattatttcctctttgtccgagctgatgcagatattctgactctcttgcgccgttttgttattgacaaagagggcacaaacctcatctccggttattcggatgcatatcggtacacctttcttatcacctgtttggaatccttctccaagcaggttttcttttttaacgtgaggtcgatgtaagcgatatggtgtcgattctcatgagaaccgccttatcgatcaagctcttgttggggcattgactataaccgaatcagaaaatgaaagggaaaaagtttgacgtctcattggatgtcgaagcctctcgaagctgaaatctctcaaccgagaaatgaaatacgctgacaaacaggatattgcatattttcttcagatcgaatccgcattgttttatagccattcggaacatacgccgaaagggggtcgagctacgccctacagcgactcgggctacgccgtagagcgtaccgagctgcgctctacggctcagctcggccacctctacggctcccggagcggaactctacggctcggctcgctacgctgtagagcgtacctcgccgagctctacagcgtagctcgaagagctgtacgggatagcccgttatcctctacggtgtaccgccatctgccttgtggtatagcccatcttcctgtacggactgcaacattcggtcaaaaaagcaatccgaatttcaatgttggttcgatccgggcagaagcaggattgccccctatacaattgcctgaacggaataacctataactcccaagatcttagtgtgtaacccgctaatcggggaacgaatacattggcgttttcttacgccgaacaggggttgtttatggtgtgcctcttcgatcgaggtgtactccacctacatgtagttctcggaagggaacaaagccggccaatcacgtttctaatcaaggtgctaccaaacgatcggggctatgccgtgctggcggagatatgcgttggttcggctgaaatgcttgcagccaaaaaaaccgcgatgtgctgagagtggcgaaggatgaggtgcttcgagaatgagatgacagcgaggatcgatcatggctgattttcggcgggcataacttccccagaggagaaagacaaggtgttctctacgcttggccaaggcttctatggccgcatccgtaaaggtctcccatccatgcccttggtggctaccggcctgacttgcacgaacagtaagcgtggcattgagcagtaatactccttgctctacccacggcaaaagacttcctccatctatatgagccggctgtccggtatcggtacgaatctcttcgcagatattgcgtaaactgggaggaatgggtataccggtcggcactgagaaagccaacccttcggcttgcccgggttcatgatagggatcttgtccaagaataacgactttgacgcggtcgaaagggcaagtgtcaaatgcccgaaaaataaatcgggccggggggtaaatcggactctgccgatactcttcacgcacaaagtcggtcagcttttcgaaataaaatttatcgaattcttcctgtaaaacctttttccatccggcttcgattcgtacctctttcatgtttttctgtttatgtaacgtgtatattgtctttcaaggacggggctttacttcgaaagcccccacggtagctgtccggcggggttctccggtcaagtcatgggggaacaacgctatgatagcaggatcggctttccctacgaatggggcattgggcagaggatgatagtcgtagcggaagttgtacttctttttgatcaagtcgtaccctacactataatagatactgtcggccgggttgttcttgtcggcctccatcacattatatccgacattgaggatgctcgaacgggcacgtacatagctgttgcgtatcgtaaggcgtgcaagtaccgaggcttcattatcggacggtgaaccgtcggacagactgatttctcctccactctctttatctccctgtttgaccacagaccgactgccatcgacaatactgttggacaaaatcaaacgactgtccgatgagggagtataggatccgcctgccacatcgggagcgaatgccgtcacgtagcgcaaggcttccccttggcggttgtcccatctatagaaattgcaaacagtgctttgggtcaattcgcatacgctgccgaagagggctacagtatagccgagggtattgctgatctcactgttgagaatacggatatagccaccggaagcagccagaccggagcctttcgtattggtgaccatacagccctccaaaagcaattttggggtggtgacatccttaccgccttcggcaatgattccccatcgaccgttgcggatagtagtataacgaagttcattgccacgactctcttcagagaaaagaataccgccccactgtccgggaacgagggtataaggtacatcctgtacgaggagatcgtggcgcagattctctatcatcactcgcttggccggattgccctccgccattaggcgaccccgaaccttgatgtgggccttattggccatcagcagacggcatccggcaggtaaagtaagggtagcaccctgctgaacgacaaggctgtcgagaagcaaggtgggacgttgtgctccaaatatcggatcccgatcgataaccaaagccggtcacttc

SEQ ID NO: 809 - DNA (genomic), 3016 bp, PORYPHYROMONAS GINGIVALIS; double-stranded, circular
  misc_feature 1...3016
  hypothetical: NO
  anti-sense: UNKNOWN
tgcaacactttctacagaaaaattcccgacgaggctagcctcgtcggggaataaaatcaatcgtttgatttcgtgttgcatttatcatattaagggtttggacaaagaaagagaagagacattctgcgctatctttgcttgcagatgatagatttatttcagatcgatacaggatcttctctgcttctaccattcgcagatgaaggtattcgcgcgggatttccctctcctgcacaggactatatggatattgccattgacctgaatcatgagttgataactcacccatacagcacgttctacggaagggtaaagggcaattcaatggaagacgcccatgtgttcgacggcgatattcttgttatagacaagtcccttgaagcgcgggatggcgatatggctgtctgctttttggatggagaatttaccctgaaaacaatccgcatcaaatcggaagagattctactcgaaccggccaaccccgactatcctaccatacatgtatcggcagacaacgatttcgtcatctgggggatcgtaacctattgtattcataaaataagaagatgatcggcctatgtatgccctcttagactgcaacaacttcttcgtcagttgcgaaagggtgttcgacccctcgctccgaaacaggccggtcgttgtcctctccaataacgatggttgtatcatcgctcgcagcaatgaagccaaagcattggggatagggatgggacaacctttcttcaaggtgcaggacttgattcgccggcacaatgtggcattcttcagctcgaacttcattctctacggcgatatgtcccgacgaatcatgtcgcttgtatcggaacttgtacctcggatgtcgatctattcgatagacgagtgtttcatggatttgagaggagtgaaagattatatgtcgctatgccacatgatagtcgatagagtccgccaatgtacgggtataccggtgagtataggtgtagccgatacgatgaccctgtccaaagtggcagacaaatatgccaagaggtatgcgggttacaagggcgtatgcgccatagactccgaagaaaagaggagaaaggctctgcaaacgttcgatgtaagcgatgtatggggaatagggcgcagactatctcgcaagctatactattatggtatcaatacggcagccgactttgcttcgatgagagaaggtcgggtatatcgtttggccggcacttcgggcgtcaggacatggcaggagcttaggggcgaagcctgcaaagagatgaaattgccacagcctcgccaaagtgtctgcaccacgcgctctttcggccatccatgccgagattttgactcccttctcaggcatttggctgttttcgccgatagttgctgtacgaagatacgtgaagaaaagagcagggcacgccgtttgagtatctttataagctgtagccgatttgatcaggagaacgactattccggccggaatgagatgctccttcccgtagctacttctgacccttcagaactgatcccaaagattcgcaccctgctacaagagatttatcgaccaaatctgccctacaaacaggcaggggtgatcttgtccgacttggtagcggaggcctatcagctcaatcttttcgacccgatcgatcgcatgcggcaggagcgtttcttatcctctgtggatgcgatccgccagcgtttcggaagagatagtctgaccgttgctacccaagaaacagaagctatagcatctgtctcttcgatcaagcatcgttcgcgcagatatacgaccgatatgaacgaggtcatagatgtcgttctgcccgatcagcgaaaaagcggagaaaaaaaatcgacgatcaacagccggtagagactgttgcatgggagtttcattgaactcttttgctgcagagctgattcttagtgcctttgggaaagatcaaacctccggtatatggacatcgagcaaacagaaatttccccaagtttccattagagaagtactcctttcctcgtcaaataggcgagaaataagaaacgattgtcggctgtttcttgctccctgcacgatgcaggacgcgattgtcagctgattcttgctccctgcacgatgcaggacgcgattgtcagctgattcttgctccctgcacgatgcaggacgcgattgtcagctgattcttgcttcctgcacgatgcaggacgcgattgtcagttgattctagcttcctgcacgatgcaggacgcgattgtcggctgattcttgcttcctgcacgatgcaggacgcgattgtcagcttgattctgctcccatcaatgcgctaactatcagctatttgcaactattttataggacttttattgaagtcttttgccgcagagctgattcttaagtgtttttcagattacttgaggtttgcagagagatcgcatgaagctctcctttcttcgtcaaatcaatgcttgtgtctgtcttgatcgatatgaggaggtgggaggttattgtgcaacagtctcaaaatgtgaagacgctcggaatcggtcaaatgtttcgacacgattactgattttttgacctttctgagtatcaacttttttcccgtacacatcagaaatgattggtgtacagatcggtatgaacagccgttttgccgatttgttgttagctttcagccgctttcatgctcgattttacctaaaaaacgggattgtgaacactgttcaggctttgttcctttgtcatgtaccaataatgagatcaaattgacgaggacaaaaaacgagatggatgctcgtgccagaatcttgcgagctgcacgagaggaatttatggtcaatggtttccgagatgcttctctccgaaccatcgctcgcgaatcgggagtagcccgtgagcaatatatacaactacttcgagcacaaggacagcctcttcagggctgtgcttcaacctctcttggatgaattcgggcggataatgggaggtcacaacagtgagcaccattatggacgt

SEQ ID NO: 810 - DNA (genomic), 879 bp, PORYPHYROMONAS GINGIVALIS; double-stranded, circular
  misc_feature 1...879
  hypothetical: NO
  anti-sense: UNKNOWN
gggtatcggactctgtagcatcaatctcggagaagtagacgaagaaaaaggggattatcaaaaggctttgcaagagtatgccacggcatacaaactgatggaacagttgtccgatcgatggcactggctgaattcctgtatcccgatggcacgtatcaatctcaaacaaggtaacgaaaggctctaccagcatttcatttctttggccgaagggactgcgaaagaaattaattcgacttcacatctgatagaaatatacaatcttcaatacgagaatctcgagcgtaaaaaagaatacaaacaagccctcgaagcattctgtctgagcaagacgttgagcgacagcatgtccattgcgcacaaggtcagcagcatacaagaaacgcgattcaactacgaacgaaacaagtcccaaaaagagcttgaagaaatacagcaagtaagcaaggcaaaacaagagaaatcgaagtttatcctcttgagcactctttttgcccttttcatctcgattcttttgatttctgttctgacatatgcataccgtcagggcaagaagcataacaagctgatcaaagagacggataaacttcgctccggctttttcaccggtattacacacgaatttcgtacgcctatcaccgtcatacaaggtttgaatgagaaaatgagttcaagtcctgatctccaagcatcggacagaaccgagctgcacaagataatagacagacagagtagccatatgctgaatttggtgaaccagctgttggatatttgcaagatcagaagcgagtatccacgcccgaatggcgcatggcgacatcgtctcttcgtacagatctcatcgatcgttgcacatacgcacaggctcaagacatacct

SEQ ID NO: 811 - DNA (genomic), 4413 bp, PORYPHYROMONAS GINGIVALIS; double-stranded, circular
  misc_feature 1...4413
  hypothetical: NO
  anti-sense: UNKNOWN
aggtaatgtctataatctcaaattctaccaatccactcggcactttgatcgaaaccaaatctccgatttttttacccatcagtccctgtgcgatgggtgtattgacagagattttgttctctttgaggttggcttccgaatcggaaacgagggtataggccatcacgacacctgtctttacgttcttgatcgtcaccttgttcagaatctgaacgctttcggtgcttacttgcgattcgtcaatgatacgagcattggcgatcagcccctttagctgggcaatcttcgtttcgaggattccctgggcttcctttgccgcatcgtactcggcattttcggataggtcgcctttgtcgcgtgcttctgctatctgccgagaaatctcgggtcgctgtacgctttcaagttcagccaattcggccaaaattttatcgtacccttcctgtgtaatataattgtatgccatactgtcttgtatgtaacgttggttgaaaaaaaaatttttcttcgggctgcacctgacagccattctcgtccaaagagaaaaaagaagcccggaagatacccatatatatggaatgtctccggaactctctactctttctttaagtcgtttgagcaactttacgctcggtgcaaagatagtaatctttcttataagagcgacttttgttcttcggacgaccagggtgcaaattccagcaataagtgcaacactatggtgaattctgtaagaagcactcgaacggagtgccgaatccgagtttctttccgggtctgtggttcagtttattctgtataatgagacctttgcacggcaattggcgtgcaaaggtctcttttcaggtgtatttgagggaaaaaaattgatggctccagccggttctccatcagcttttacctccaccactgtttcttttggagcaaaaagaaaggagacagctgcttccctaaggcttgcttccgccttcgcgcagaatggtgtagggcgagacggtgcagtcgaccaccgtggtctgttcgaacgggatgattcctccgtcgagtaccatttctaccgtaaggccatagcgctcttcgatcagttcgggatccgaagcgtattcgggcgtttcaggatcgagggggagcgagccggtcagcaaaggactgccgagcgattcggcaagaagacgggtcagtggatgaagagccaggcggatacctacctgctttcgattcttgaaaaccttaggcagcgaacttccggccggtaggacgaaggtatatttctgcatgtggttgtccttcatatagcggaatgcctcgttgtctatacggcagtattcggctgccatgctcatgtccgaacacatgatcgagaggcttttgcgccgaggatccacacctttcagctcgcatatccgctccacgctccgattctgaagggcatcgcatccgtaggcatacccaacttcggtgggatagatgatcactttgccgtcgcgaagagccgatacggcacgttccaattctcgtctgttgggattgtcggggtaaatcttgatgatcatatcatttcagtgtatatcgaaatagggtgaaagtcttatactgtcttcttttgtgaaggtcggtagcttcagtagttgtacccagctaccctgccattggctgctgcgtagcagccgtttgatctcggcccgttgtttatagttaatataaggatgccgaaggatactatctcctacgactccttttagatcgatacgatccggcttgattcctattttgaaccatggtctcagagcgcaaaagcgttcgtagtccatgccgtaaacctcctgtagctgtagcacggtatagtagccgccaagctgtcggcggtaggatacgatgcggcgagcgaatgtaggccctatcccgggtatgcgagtaagggtagccgaatcggctgcattcaggtcgatcaccgtaccgcgaggaaatttatcggccgatcgggcataggcttctctgacaggaggccccacgtagtccgcatcggtcacgatgctgtcgcggcttttcttgcgcgattgttccgaggatgaataaggcctgacgtaattcttcttttcttcttttctacccggttcatcagccgacgtttgaacagcttcggccacaggtgcattgccactggccggccttgctttgaagatgaatagcccgacgatgaccatcagcaggagcaagatgctgataatgctttccgatttgccgaagtggaaggagtctttcatctgtgtatcggggctgtttggcggttgggttattccgagaagagtagcccgtcgcgcatgtggaggatgcggtcggtgccggctgccaatttctcatcgtgggtgactatcaggaaggtctgtcccatctctcggcacagacggaagaagagagcgtgcagctcttctttgtgcgctgagtccagactgccgctcggttcgtcggcaaggatgatggccggatggttcaccagagcacgtgccacggctatccgctgcttctcaccgccggagagttccgatggcttatgcgaagctctgtcgctgaggttcagatcggaaagcagccgttcagcttcgcaagaagcctcttttcggctctttccggctatcagagccggtatcatcacgttttccagagctgtaaattcgggtagcaatcggtgaaattggaagatgaatcccagccgtctattgcgaaattcggcttgcttccgattgttcatgcccattatatcggtgccgtcgatacgcaattctccgctgtccgcccgatcgagcgtacccagaatttgcagcagcgtggtctttccggcaccgcttgtgccgacgatggagactatctccccacggtcgatggcaatatctacccctttcagtacttccagagagccgaaactcttgcgaatgttgcgagcttctataatcattgttcggtcagtttttctattacataagcggctatcctgcaaccgaaaatagccggcatataggatatggtaccggctgtggagcgtttgcagcgttctccttcgatctccattacagagctttcgtccggcaactcgctgctgaatacgaccggcacgccgcgtgatattcccagcttgcggagtcgcttacggacagcacgtgccaacgtgcagttgtacgatcgggctatgtccgccacatcgataagcgaggcatcgcgtttggctcctgctcccatcgaactgattaccggcaggcctcgccgcttgcttagggcgatgaggaatactttcggactgagcgaatcgatggcatcgaccacaaagtcgtatttggctgcatccagcagctcctccatagcctcatcttttagaaaagcggcaaccggatagacctttacccgtggattgatatcctgcagacgatcggccaacacctctactttagaccggccgacggtactgtgcagggctatgatctgcctgttgatattggacggattcactacatcggcatccaccaaagtcagtctgcccactcctgcacggcagagcatctctgctgcatagccgcctactccgccggtgccgacgatcagtatatgcgagtgccggagcttgtcggctgcttccgtgcctatgagcagctccgtcctctcatcccaactgccgtccatgaggggcttttccgtttcttcggtcatttgatccccctttcattgagtgctttgcgatagagagccgcattgcgttggtgttcggcataggtgtgggcaaaacggtgacggccggagaagtcctccttggcacacatatacaggtagccatgccgatccgctcggagcacgctgtccatggtcgcggtatgcggtagccggatcgggcccggaggcagtccttcgtttttataagtgttgtacggggaatccgtctgcaaatggacattcaggatcctacggatggaaaagtctcccatcgcaaacttcaccgtcggatcggcctgcaagagcatcccctcacgcaagcgacggatatagagaccggctatctgcgggtattcatcggattttcccgactcctcctccacgatggatgcgataatggatacttggatcggcgtcagccccaatgagtcggccagactccgtcgctctgctgtccaatagcggtcgtagtatctctttcagcctcagaaccaagtcctttggcctaatgtcccaatccacttcgtatgtttcgggcagaaaaaggctgcggatggagtgtggatcgaatcccagcgaatcgcagaaagcggagtcggccaacagggaagaaagctcttccggcttcatcatcagtttgcccgtcatccttccgatcagatcctcctgtgtgcggacgtggcggaggtggaagcgtacagccgactgttttcc

SEQ ID NO: 812 - DNA (genomic), 2381 bp, PORYPHYROMONAS GINGIVALIS; double-stranded, circular
  misc_feature 1...2381
  hypothetical: NO
  anti-sense: UNKNOWN
gagccgacacgagagaagcatctccctcttcgggcgtattatctcctattgcgctcccgccatccaccttgtccacgaaagcatacacttctactttcggtgtcagaatttcatccgtggcgacggcagtgaaaggcaacgatagctccttagtaaagcgatcgccatggatcgtgtaaacggcatctgccaacgatgccgacaccacaagagttcgttcgtcatccgatgcttcaacctcaacttccttggtggaaggtcgaaacaggcgagcttcggcatcccattccatatccggataggaaatttgcacatgtcgatccaagcgacggggtataccattcggctgaaaatagggaataggccggatggctgcatccacagctaagtccatcgagatacagggagaggtctcggagggtttccccgtaacagcggaaacaaataaggcatagtcagcatagttgcttatccaatagtactgaggcagtcttccatctccggacacgaaataaccacagttgagctgaggagcggtcagtgtccacataccatccgaatatgtagctgtagtcacttcttccgcttcgatagctttggtcgtatagcgatacaactttcctgtacctgctccggcaaaacgcaggatgacagatgcgggattcaatgtatgcagcataaaaacctgcaagcgattgggtgaatcatccagagctttcatactcggtgcaccgactatctgtatctgtgcctttgctgtgccgaaagctaacatggagagcaaacacagctttaagagtgtacacaactgattatttcctttcatccgattgtttttcttttttatccggccaatgattttattcgtgagagcgaatggaaagaaggaagagcacgagagatgcccggctgacagagcatcagtattccattgtcttggcaaagacgaagttcttgagcgacgtacaatccgaagagttcagcgtagcactcgatccttcccactccttactgccatgacggatgtaaatgatcttgtccccgattgtcttcacggagttcatgtcatgagtattgactactgtggtaataccatgctcttgtgtaagactatgtataagatcgtctattacgagcgaagtcttcggatccaaaccggagttaggctcgtcacaaaagagatacttcggccccaaagcaatcgcacgggcaatggcagcccgtttcatcataccgccactaatttcgctgggatacttatgtctggcatcggaaagccccacccgatgcaatagatacttagccctctctcgacggactgccggcttatcgctcgaaaacatattcatcgggaacataacgttctccatgacagtcatactgtcgaagagcgcagaaccctgaaaaagcataccgacttcgcgccgcagaattttcagctcactctcactcataatcgtaatatctcgaccatcatacaatacctctcccgatgtaggagcaataagcccgatgatgcacttcagcaggacggtcttacccgctccgctgcgtccgatgatcagattggttttgcccgtctcgaatgtcgccgagatattgttgagtactttcttgtcttcaaactgcttactgacttctctgacttcgatcataatacgttagtataacatttacgcaagcaataaattcgtgaggagtaaatccgccacaagcaccaatatactgcactgaaccacagcgttggtacttgctttccccacctgcaatgccccacctttcaccgtatagccgtagtaaccggccacgctcgatatgatgaaagcataggccaccgacttgataatggagtaaaacacattataaggggaaaagaaaagctgcaaaccgtactcaaagtcgctccgaggcaaattcggcaccaacgaacaggccagataaccaccgacaatacccgtggacatgctgattatactcagaaccggaacgaacagcatgaatccgatgattttaggcaggatcagataattggccgagttcacacccatcacctccatagcatcgatctgctcagtcacacgcatggttcccaattcggaggcaatactcgaccccaccttaccggccagaatgagacacataaccgtggaagaaaactccaacagaatgatctcacgtgtggaataacctatcgtaaagcgcggaatgagcggagaggtcatattcagagatagctggatagtgataacggctccgatgaagaacgaaatgataattacgatccaaaccgaatccactccgagcttgtctatctccttaatcaattccctgaatgacatcctccacctgttaggcagagagaatgtccgctggggatcctc

SEQ ID NO: 813 - DNA (genomic), 1020 bp, PORYPHYROMONAS GINGIVALIS; double-stranded, circular
  misc_feature 1...1020
  hypothetical: NO
  anti-sense: UNKNOWN
aaaagattggcaggagtttttggtaaccaatgggttgctccttttgaaaatcacatggcaaatggcggtgaaaaccttttcggaaatgcgagctcaattaagcgcagaccggatgggcgtgtgtacggtatccggacaaatgcaaagacacgtattgttctctgccattgatagattgaatcatttggataaggcaaaggggacaacatttgtatctaatggagatggcattacaaacctgattgagattgacttgcgtgcagatctgggagggttcatgcatacaaataaaggagattattctgatagaagaattgcaccactgtccgtaacaccggccacggctcttgatacaagttctgtaggaagagacctcttggtgagaattcgcttcgacaaaagctctgatgctaaaaatcaagcattagcgacaagagaatacagcgaacaggataagatgaatatgaacttcttccttgacataacatctgttggtgtcagcaaatcttttgtttataaagatggattaaatttaggaacaaagtactttaaacatatcactgacgacgagaaaaagaggagggtaaagctattcttagaagcaactcgaataatgaatgactacgcaaaccaagctcgtaatgcagtttgtggtgagccagaaaaagtattgatcgtttttgatgatagactgagcaggaaagcctgtcgttactataccgtaggtgaaaaggagcaggcaaacattataaaagaacttgatcagtaccaagtaaaatattttgtaggggatgatgcttcagattatagcgtagccgatgcttatcgtgatgcgatgaattaccttgataaggcaacacttgtcgattttgcagagggcgaaagagataatgacttttgcagaagccttcgagtgcaaggaaaaagaacctcaagagaaaaaatctaaaaaagggaaagacaaggccacttctgctcagaatctctttgcagaacaccagatgatcaataaagaatcgc

SEQ ID NO: 814 - DNA (genomic), 683 bp, PORYPHYROMONAS GINGIVALIS; double-stranded, circular
  misc_feature 1...683
  hypothetical: NO
  anti-sense: UNKNOWN
tacgcagttggttttcacccgtgattcggcacctgccgaactatgcgaccgcgccgaagacttgggacgtgagtgggtgatccgtgccacgggcaccgtcatggagcgctccagcaaaaatccgaatatccccaccggcgatatagagatagcagtcggagaaatggatgtgctgaaccgctccgaagtgccgcctttcaccatcgaagacgagaccgacggaggcgatgacctccgcatgaaatatcgctacctcgacctgcgccgccactgcgtgcgctccaatatggaactgcgccaccggatggctctggaggtgaggaagtatctcgacggcgagggattcctcgaagtagagacccccatgctgatcaagtccacgccggagggtgcccgcgactttgtcgtaccctctcggatgaatcccggccagttctacgctctcccccagtcgcctcagaccttcaagcagctactgatggtaagcggcttcgatcgctatttccagatcgtgaagtgcttccgcgacgaagacctccgcgccgaccgccagcctgagtttacgcagatcgactgcgagatgagcttcgtggagcaagaagatgtgctgtccaccttcgaaggtatggccaagcacctcttccgtaccatccgtcacgtggagatttcggaagccttccccc

SEQ ID NO: 815 - DNA (genomic), 850 bp, PORYPHYROMONAS GINGIVALIS; double-stranded, circular
  misc_feature 1...850
  hypothetical: NO
  anti-sense: UNKNOWN
gccggcatgtaacagaaaagctgttggataaactggcaaagtattcattgttctataattcatgtcaggatatcccaagagaaaaggcaagactctatgcagatcaaatatgtagaaacagaacatggcgcaatagtttgttgtactgggcaatcaaagaaaatctcttactggaaacaggtttggatggtgaaggtctcatgtttggctttcagaagattggtgacttcctaatggctgatgcattttgcaaaagcaaaatgaaagatagtgcgaaagtagattttgtcatagagaagtcagaatgtcagcaatatcccctgtacaagcgttttctcgtggccttattttcggagtggtcccttatgccagagtttttggatagggatttacttgtacgcagggagacgttgttagatattttgttggaaagtctgcattatcgatcaagaaacaataggttggtattcagttggatggtaaaagaacaggttttctcattaaggatattgcgtgattttataaacatattgccggaagatgtatttcgtatggctcacagtaggttgatgaatgcatcattggttaatagagataagaaatggacaacgtctgtgaattctatatatgactccttcttatctagtaatgtagatgattttcttgaaattgaaatcacagagaataacaatcggaaatatctaatacttctaggatggatgtgtgtatcaacgcatccttttatcangggtagagccgttgagaaaattggtgtatttggttgataaggcaccagagttttaccagaagcttacgtttggttgcttcatgccatgatatgtatgtggga

SEQ ID NO: 816 - DNA (genomic), 3447 bp, PORYPHYROMONAS GINGIVALIS; double-stranded, circular
  misc_feature 1...3447
  hypothetical: NO
  anti-sense: UNKNOWN
gcacattgctgacgtgggctatcgaaacgattttggtacgttcgttcagtagagaccggaaatgctccacatccagttcgcccgattcggtcaaccggatcactctgagccgagcaccggtacgttcggccaaaagttgccatgggacgatattcgaatggtgttcgagggtactgatgataatctcatcgccggagcggacgaaagcttggccgaacgaagaggccaccagattgattgcctctgtggtgccgcgcgtaaagagcacctctttggggtcttccgctccgatgtagcgggctatccgcttgcgagcattttcgtgttgctccgtagccacctgactcagatggtgtacgccgcggtggatattggcattgaatgtgcggtaggctcgttcgatttggtctaataccgctatgggtttctgtgtcgtggcggcattgtccagatagatgagaggtttaccgtgtacccgggtatggaggatggggaagtcctccctgattttttgaatgtcgtacataatgagctatactatatactatgtatgtgacctcttcggggcggagggaggagagagcctaccacttctcgcggtgaagaacctccgaggtttctttgcgcttcttggccctgtgcggatcggcggaatagccgagcatgatgttcatgactacgcggcgtccggagggaatgcccagtatttcgcggatcttggcttcgtttacccagcctatgatgcagctgccgagaccttcggctgtggctgccagcgtgatgtgtgcggcggctatgccgaggtcgatattggcatagtggatttttttcattttccccccgatggtcgccgtgaagttggctttctcttcgactaatacgatgtgtacgggagcctgacgcgtgaagtgattcatacccaataaccgtgacgatgaggcttcagccagttgtctgcgagtgtcgggatcggtgacgacgacaaagctccaaggctgcgaattgcaggctgagggggagagacgccccgcttcgatgatgcgctgaagcacgtcttcgggtacggggcggtcgggatcgaacttgcgatcgctctgtcgctgttcgatcagggagtaaaagtcgttcgggttcattggtattggagcatcttgctgagatatttccccacaatgtcgaattccagattgaccacactacccgagacaatgcggcagaagttcgtatggtcgcgagtataggggatgatagccacacggaagttgttcatgccggagtcgcatacggtcaggctcacgccattgacgcatacggatcctttctccacggtcatatagccttggcgagccatctccttgtcgagcttgtattcgaacgaatagtagtgactgccgccggcttcttccacagcggtacatacagccgtctgatctacgtgtccctgcacgatgtgtccatcgagccggccgcccatcatcatgcttcgttccagattgacgagatcgcctatttggaggagtccgaggttggaacgttcgagggtttcgcgtatggcagtcacggtataggtggtgtccgtcttgctgactacggtgaggcatacgccattgtgtgcgatgctttggtctatcttgagttcattgacgaaagaacacgtcatcgtgatgtgcagattgtcattttcgtgacggagatccgtcacttgggcatattcttctacgattccggaaaacatattgttgttgtttttaattgatgaagcggtacaaaactacagaaaatatagtgatggtaagggaaatatgcacaaggcagatcaggatggagtagcttttttcaggacacgtcacacgtcacaccaaacttttcctattgtacgctccgaaaaacgtagggcgagaaaattttcgttttcgtgtgggaagcaaaaaattttcgctccaaaacagaaaaattctcacgccacattttcagaaaacacgcgccacaatccgaccgtttttggttcgtatttcggcagccggcaggctgtaggcattcatctgtaggagcaatggtttggcatcaatgcctccaaaatggatgcagcttgtcgcattcgaatccaccttaatgatccggataaagccgccgattaggattaacgccgaagactgcaaagcaaaattcgaattaacggctcccggctgccaacccatttccgggacaggccactgtttttctgtttgctgcttttttccgtactttgaactgtattttggaacaaaaaatattccgttggcatgcaactaaagaattttcatcataaatatcccgtcctcttccacctgattttgatgactttggcttcagggcttatcctcatgggtatcttgttcggactggatatttacacgagacacgacagctctatcgtgatgccggagttgcgtggcaaagacttgaaggaggcagagcgtttgctgtcgagccataatcttcgctacgaacttgtcgattccgtttatgacaaatccttggctccgggtgtcgtagtagaaatggttccacagagcggcaataccgtcaaaccggggcggatcattttcctttcgatcaatgcgagatcggcacggaaggggatcgtccctgatctgaaagatatgtccggccgccaagctctggccatcctgaaaggattgggcttcgaacaagtcacagagcgatacatctcaggcgattttgtcaatctgacagacggagtcgaactggccgacggccggaatgtacttgccggtactcgcctgccgataacgactccgttggtgctacgggtgatcaacggctatgcgccgcttcctgctgattcgtcactgatcgacgaatcgatcacctacggttcatcgcaggacagtgcttcggggaagaccgaagaggagaatagcgaatcgtggtggtaatcgggtataccttatggaggaagaacttcagtaccggatgactcccgagatggcggagctattcgacgaagacgatgcagaggacatctcggacggcggactcgacccggaggaagaggacagatacgaacatttccgcactgtagcagatccgggacagacacttattcgtatcgacaaattccttgtcgacaggatgaacaacgccacacgcagccgtatccaacaagcggctgaagccggtgccatattcgtcaatggccgaccggtaaagagcaactaccggatcaaaccgggcgatgtggtcacgttggaactcctccggccacgacgggaattggagatcattcccgaagatattccactcgatatagtgtatgaagacgatgtactgctcgtgatcaataagcctgccggattagtggtacaccccggccatggcaattacacgggtacactggtcaatgcactggcctactacctccgagaggatcctgaatacgacccc

SEQ ID NO: 817 - DNA (genomic), 4963 bp, PORYPHYROMONAS GINGIVALIS; double-stranded, circular
  misc_feature 1...4963
  hypothetical: NO
  anti-sense: UNKNOWN
cgccgacagcaacgacgaactgatgaatctctcccgggagataatgcccgaactgacccgtctcagtacggatatagccctgagcgaacccttgttcgtgcgcatccgaaccgtatgggagagcgatgagaaagaaaagctctcggatgaagaaaaacgccttctgtataattgctatcggggctttgtcgatagcggagcactactccccacagagaaaaaagaccggctgcgtaccctgtccgaagagatgagtatggcctcattgacattcggacagaatgtgctcaaggacgagaaacgctacaaactccacctcagcgatccggcggctgtggccgggatgcccgagacggctctcgctctcgcttcggagaaagcccggcgaaagggctatacggagggttggcttttcgacctttctgctccgagctactttgcttttatgaagcattgtcccgatgggaacctgcgccggcagatgtatgaagcgaaaatgtgtgtcggcttcgtagacaatgagtataacaacgaagctctgatccgtagaatggtaaacggccgtctcgaggaggcacaactcctgggttacgataccttcgcccactttgctcttcatgacaggatggccaagaaccccaaggcagtccaagaactactggacaaactactggatgcatacaagcccaaagcgacagatgaattggagatgatccgcaaatgggcttgccgacaagacatccgaagtcgataacttcacgatacaaccatgggattgggcatacttctcggaacagtacaaacaggcccactacgatctggacgatgagatgatgcgcccgtacttcgaattagggcgagtcacacgtggtatcttcggcttggccaaccgactgtacggacttcatttctccgaacggacggatgtgccggtctatcatccggatgtaaaggtgtacgaagtatcggacgaagacggctcttatatcggtctgctctacacggatttctttccacgcgaaggcaagcaaacggagcatggatgaacaacctccgggaccagtccgaacatcagcacccgcacatcatcatcgtgatgaacttcacccctccttcggcggacaaaccctcgctcctgacagcaggtgaggtggagactttcctgcacgagttcggccatgccctgcatggcatgctgtccaaatgccgcttcagctccttgtccggcacctcggtagcccgtgacttcgtggaacttcccagccaaataatggaaaactggctgacagagaaagattttctcgacacctttgcccgccattatataacggacgaacctatgcctaccgaattggtggaaaaactcctctcggcacgaaattacctcgcagcaagcggtgcatgccgtcagctcagcttcggctatctcgacatggcatggcatggattgtctgctccggtggatgacaaattagacatcaaggcttttgaagaggctgcttggtcaaaagctcttattctacctccttcgcccccgaatgccgtgatgagcacggccttcggtcatatattctcgggaggctatgcagccggatactatggttacaaatgggcggaagtgctggatgccgatgctttcgcagctttcaaggaagtgggtattttcgatcgcgaggtagccggtcgtttccgccgtgagatattggagagaggcgatacggccgatgccatggagctgtatgtagctttccgtggacatgagccggacattgctcccctgctgaagcgtaccggcttggtttagcctcatttatgcggtctcaataccacgtaaaacgtaagcccgaaagcgacacgtcgctttcgggcttactgtttttatcctgttttggaaacctgtgtctgaaatacaggggatatgatttactggcgaatgccgagcttcttggcgatggctgcagggatagccttcttgtgtacgatgatattcattgtcctaccggctacgaagttgtaagaagcataccagatacccttgtacttaccggtttcgccccatgagtttttcaccatgaagaacttgcgtccattctgattcttggcgataccgtagataaccataccgtggtcatcggtgaggctatactcatcgtaacctttctgacggaactcttgagtggggttgatttcaggacaatcggcactattaaccgtacgaatgatctctgcctgcttctcggcacggctcaatcctacccaacgatcctgatccgaccctttggcttcgataccttctacgtcggccaatacgccgataccatcacgcgtaaagcccacttcgcttacgtccgaaccccatgcgatggaatagccgttgttgatggcatattccatagtctccatcagctcgttgatgggcatattataggagagagagccgcgccagttgtcttcgatttcgagggcaaactgtgtgtaaaaaggatgatgcgtataagaagtcagcgacacatagtcatcgacattaagaccgagatactgagcaaagctcttcggcgtgtaggtcttaccttcataagtgaaagtttcaggacatgtgccgaggtagctgtcgatgatcccatcataggcttttttccatgcaggagtgagcttgccattaggattcgtcacgatagccttgaggtaggccagagcaccgtcggccaattcactgtgagcattcttcttcgtgccatagttcaagccctgcatgacagactgtggaacgacgccgtagtgcttcaccacatagagaacatcgtagaaggaaccgccctgtccgaagttcagcttcccatgcatacgtacatacttctcgcctttgtccttgtatgattgagctacggagtgcatttcggccaagtccacttcgggctttcccatacggaggatttcgctttcgaggaatcctaatgcagagtatgaccagcatgtacctgagttggcctgatctttcaccggcgtaattggcacttctttaatagtagtgaactgattctctacaacgtctgcactcttctgttgagcttgtacgacgaaactgctgcaaacaactaccgcagcgagcaaaagcgttttcttcattctatgtttttgatttttaatagtgagtgattttctcatatggtcgcaaatataagaatatctacccattcgagtcccaaatatcgtccatccggcagggcgatcgcatttgaagtgttaacacacatataggcctgatgatgctccgtccggaataagcccgaattaatgtgttagagatcccaattgccgtgcaaaggtctcctcataggtattattggttgctactgtgtgccgatggtggccggatggattattggagccggaggcggtatcggctcgtatggacgcaatgtgaatcagacggcacagcgtggcacaggtgcatatacggggagcaaggcgatgattggaggagcacaagtgctgttgccggtcatgtcgtttgatgtctcaaaggggcactcattaaaggggagtaaatttccaccattggaaaaagaagtttccactagtggaaagtttattttccaatggtggaaagataactttccacttgtggaaatccggcatgtgccaaatagtcgcctgacacacaataaaaagaatgaacaaaagtgcctgcttattgtgcagagttcccatttggatgtaacgtctctgggcacaaagacaaactatccttacggaagaggttgttcaaagccgctctgaatatagactatctcaaaaagctactaaagatttgatgcggttgccctcttgctcccctaccgaagttaattcaagcaaaaacatcaaaggctgcaaccacccatatcggcagccgcagccttcgttgtcagaaattgaaattctttatttagaaagtgtacgcaacacccacgcccacaacttctttgaactggattttcgggccatcgttgatcttcacatcatcgtcgtagataagattggtggctatcgtagccgtgaggaacttgttgatcttcatggccagcatagcctcccaattgatgtcaatgttgccaaagtcgtgcgtataagccgagaagaatgaagccttggttatcaaattgacattctccatcagatttatattggccgaacccactaccaaagcaccaagttcgaacattgtcttttcaccaactttcaccccgaaggctcccaaacttgagaggtagtcgtctgctactacagtcagcttgcccgttgtaggagagaggtagagagagaacttctcattgggcttatagtccgcaccaataccgagagtgagatatgcaggagcgaagaaattagagatatgcttgactcctgtcaagtgatccgagggcttctcatatcctttggcatactgtgagaggaaagtgaaaagcgcacttccgtaccaatgtttgccgatctcatagccggccttcgtgaagagttcgatcttgtctacacttttgttccacttgttggctgttgtgtaggtcagaccgaagtctgtacgcaaaccgttgtcccaactccatttatctttcaggtagttggcatctatgttcaaatagaggttacctgccaccgtgttttctccaccggcagcccagttggtcagagaagtctgagaggcatttagtccggtcacaccttttatagtccagtcctttttgggagtgtcagatgcagtgtttgcttcttgtgcgttcgcaagggtgaacagcaagccacccattgccagaaaaacaatcagtccgtttcatctggtattttcttctttttttaaagtgaaaacaagaaagccgcacaagaatcatcgatgcttgcacggcttgaaaaaaggtgggcccaataggattcgaacctatgaccctctgcttgtaggcagatgctctaaaccagctgagctata

SEQ ID NO: 818 - DNA (genomic), 4637 bp, PORYPHYROMONAS GINGIVALIS; double-stranded, circular
  misc_feature 1...4637
  hypothetical: NO
  anti-sense: UNKNOWN
ggttccgcttgggatcgcctttatcattgcccttctggcatctaccattgtagcccttacgcttacccccgtactctgtagctatttgctggctaagagaaagaaagatgattcgccggaaaaggaacccatcgtggccaagaaactgaaaggctggtacggacaggccctgcagtggtctcttggcaacacgaaaaaagtattgcttatgaccggtggtgtactggtggctgcacttatcgtcttcttcaccctcggacgcagttttctgcctccattcaacgaagggtcgttcaccatcaacgtaagcactctaccgggcatatcgctggaggaaagcgacagaatggggcgtatggcagaagaaatcctgctttcagtccccgaagtacagaccgtggggcgtaagacgggacgcgccgaactggacgagcacgcactgggagtcaatgtgtcggaaatagaggtgcccttcgtcctcaaggatcgttccaaagacgaagtccttgctgacattcgcgagaagctcaaagtgctgccgggtgtgaatatcgaaataggccagcccatttcgcaccgcatcgatgccatgctctcgggtacgcgcgccaatatcgccatcaaactattcggtccggatctgaaccggctgtttgcaatcgggaatcagatcaagacttccgttcacgatgtgaagggagtggcggatctgaatgtggagcaacaggtggagcgaccgcaactcaagatcgtaccgaagcgtgagatgctggccaaatacggactcacaccggcgagttttgccgaaatagtcaatgtgatgcttgcaggagaagtggtttcgcaggtgtacgaaggcaatcgttcgttcgatctttctctgaaggtgaacgatgaaagccgcgagagcgcagaccgcatccgagatctcatcatagacgccggcggacggaagatacccttcgcttatgtggccgatatagtgtcggcttcggggccgaatacgatcaaccgcgagaacgtttcccgaaaaatagtcgtttcagccaatgtggccggtcgagacctgcgcagcgttgtcaatgatattcaggaaaggatcgatgccgatattacgcttcccgagggctatcatatcgagtatggagggcagttcgaaagcgaacaggcagcatcgcgcacccttctcgtcacctccgtttttttcattttggtgatcttcctgctgcttttcaatcagttccgaagtctctctcaatcggcggtcagcctgctcaacctgcctttggctcttatcggaggtgtctttgccatcttcttcacaggtgggattatcagtattccggccatcatcggctttatctccctgttcggaatagccacgcgcaacggtatgctgctcatttcgcgttacaacgatttgcagcaagcaggcctttcaccatacgaaagtgtcctgcgaggttcgctggatcgtctgaatccgatcctgatgacagcccttacatccgggctcgctcttataccgctggcactggggggcgaacttccgggcaacgagatccagagtccgatggcgaaggtcatactcgggggattgttttcctccaccattctcaacgcttttatcgttccgattatgtatctgctgaccgacaaaagctatcgagaaaggacgtttcgaaatcgacaactaacaatcgaataagaaagacagaaaaaagaatgaaagcaatcttcataagcatattggcctttttggtgactgctcccgtttgggcacaaaacggcatgaatgatgtactgcatgccatcgaagagaacaataccgcgttgaaagctcttcgagagagcacagatgcagaaaaactgaacaaccgcaccggaatattcctgtccaatccggaagtggaggtcggctacctatggggaaaccctgcggaaatcggcaatcggacggacttcagcattacgcagagtgtcgatattcctactatcacgggtatgaagagtcgtgcagccaagatgcaagacaaactcttggactggcgatacaaaacggatcgcatgaacatcctgctggaggccaagacttgctgtatcgaattgatatacaacaaagcccttttgctcgaattggagcgtcggctccgacatgcccgcaccattgccgaagggtacgaagcgcgcctcaaagccggtgataccaaccagttggaatacaacaagatcaagctgaacctcgcctccgtcgaaggtgaaatatcccgcgtgcaggtggatcgaaaggctctgctcgtccggctcgagcggttgaacggaggcaaagagatcgcattcgacgaaagccgctatacggagatcgtgctaccgcagtctttctctgtatggttcgatcaggtagcggaaaagaatccgcagttggcatatgcccgagaagaggtggccgcaagcaagcagcaggtagcattgagccgagcagcaggattgccggttttctctgccggctatgtaagcgagaaagtcgggagcgaaaggtttcagggagtatctttcggaatatccgtgcctctgtgggaaaacaaaaaccgcgtcaaacaagcgaaagcttcggtcagagccgcagaaatgcgtgagacggacagtcggcagcagctatacagcgagcttcagctcctgtacgaacgtgccgccgggctaaagaccacggcggaaaattatcgcagactgctgacgacctccgacaatgccgacctgctcaagaaagcattggatgcaggagagatctccttgctggactatatcgtcgaaatgggactctactacgataccgtcagtcgggcgatggaagccgaacgcgactatcaacaggcatttgccgaactctcagcagtcgatttgtaattgtatatgttggattggagggcgggaaagcagcctttgtatttatcagtttccgccctccaatcatctttcatccgaaatctccaagaaagccgttttatttatgtccggtctgatctcggtttttgcgtaggcggattcggtagagattggcttcgtcttcttcgtccagctcctcgcagagggcaatgagccgtttgagcaatgagcgactttgggagttgagtccatcagcttgtcggtacgcatcgagggcttcttcatagtaagcgaatttctccaagacttgtcccaatgtgaatctggcagtaaagtccatcggagcaatggctatggcttggttcaaggtggagagggaagtggttatctcattcagcccggctaatgtcttgcctttcctgactaaggcttccacatagtcggggtagagcgtaagggccttgtcgtagcagcgaatagcagcatgggcatcatgagcctctgtgatacagtcattgcccatcagcacatattctttggccagccgacgcataacctcgcgttgctcggccaactcgcgacgcagctcttcctcgcgacggcgtgcgtactccatttcgaacagcttactcaccagcaggcgacgaaagagcgggtcgtccaattcgttcttcctcgctaatgcctgcgaaaaggcaccgatggcttccgtataatggcgagcattccacagtcggagggcttgtgcatactcgcgttctgcttcggcacgcaggagtgagccattgatgatctccaaatcattggctcgcgaataaaaatcgatgatctcacgacggacgatcacatcccgaccggcaagcggtgcacgcagcaccataccttcgagcgaacgacaccggctgagagctacataggcctgaccgccggcaaaggtgccttccgagaaatcgatgatcacacgatcgaacgtcagtccctggctcttgtgtaccgtgatcgcccaagccaatttgagcggatactgaacgaatcttcccagtacttcctcctccactttattggcttgctcattataggagaagcgtttattgtcccagatgcatggttccaccgttacaacttctccggtgctgagacatacatctatcgtttcactctcctgatcgaaaccggctactatgccgagtgttccattgacccatcgacgatctttgtcgttggagacgaatatcacctgagcatcctgcttcagtgtaagttcctcctctgtcggcaaggatgaggagggaaaatcgccttcgatagtgccgtacagggtgacggggtcgccctgcagctgttccaattgccgctcattgatgtaactcacgtgccggcgtttggtggcaagtgtgatgaccggttcgtccttcggcggctcgtaatggcgattgacacatttattgatgtcctgaagatcctgttcggtaagcctgcccgatcggattcgatcgagtatctgcacgaatgcttgctctgtctgtcgatacaccttggtcagctccactgtgacgggaggggttgctcgcagtgcctcggaagagaaaaagaaggggttgggataaaatcgtttcagtatgtcggcatcatctgccgttaccacaggttcaagctgataaagatctcccacgaacaacatctgcacaccgccgaaaggcctttcttgccggcctctgtatataccgaggagcttatcgatggcgtcgatgaca

SEQ ID NO: 819 - DNA (genomic), 2992 bp, PORYPHYROMONAS GINGIVALIS; double-stranded, circular
  misc_feature 1...2992
  hypothetical: NO
  anti-sense: UNKNOWN
tggggcatcaggctctggcagagtttttcggcggccgactacggcgaatcgaacatcctttccacgggcatgattcgccaatacggctgaccgagccggacgagcctttttggaaaggcgtaccgaacgatgccgttgtcgggcgttaccatagctgggtggtggaggataccgacttgccggactgcctgatccccacggcttggagcgatgatgacggcgtattgatggccatgcgccacaagctactgccacactatggtgttcagttccaccccgaaagcattatatccgattgcggagaacgactgatccggaactggctggacatagcgacacaaatccgaaaaacataaccctatcacataatccgaaaaatgaagtatttccaagaggcagatattgccgtgaccgtctgtgacaaaacgggcaaaatcatcgatatgaacgaacagtcccgtcaggtaaacctcaagccaggtcaggagctgatcggctcgaatgtattggactgtcatcccgaaccggctcgctccatgctcgaagagatgatgcgtcaggagcgaaagcacgtctatacgatagagaagaatgggcgaaagaagctgatctatcagatcccctggtatgaaaagggggaatatatgggcttcttggagctgtcgatggtgatccctttcgaaatggaacacaagattcgtacaccgaagccggcaaatgattgagactccttatatataggaaagctctgttcctttccgacgaaagccaagagggtgttgcaacttttgtcttgcaacaccctcttcttttcctatggatcatgaccacaggctaaacatctctgctgaaatagcaggcattaagattctaccgatatatattagaatagaagggcctgcctatacatatcgcacactcgagaaggactcctccgaaaggtttgctatgataaagattttgtaaagcttacaaagggcaaaaccaaagtatatagtttggtttcatcaaagtatatagtttggttcgaccaaagtatatagttcggtttgaccaaactatatagtttagttcaaccaaactatatagtttagtttgagggtcgttttagctcttttttccgaaaatataagtagctataaatgagagcattaaaattaagcacgccattcatgtaattggtgtgcagatacgatacgaatggcttggaaataaaaaaaacattcggggaccagccccaaacaggtttttcatttttcattctttcgctttcagcttcagtgccaatcgaccggctccgaataaacagctgcccacaggaacagtgtcgatatggatgcaatccgtaatctgtgaataaccggcaagccttgccgatggagtgtgcacagatagatattgccatgtgccggtatgaggaatcggtgtaaaatttatatttttgcgcgcatattaagaactaagcaagtgttacatggataaagtgagctatgctctgggattgagcatcggtaataatttcaagtcttcgggcatcgacagcgtcgttatggatgatttcatgcaaggtctgtctgatgtactggaagaaaaagcccctcagctctcgtatgacgaggccaagcgcgaaatagaggcgtatttcatggatttgcagcagaaggctgtcaaactgaacaaagaggccggagaagaattcctcaagataaatgcacacaaggaaggtgtgacgaccttaccgagcggcttgcaatacgaagtcattaagatgggagagggcccgaaacccaccctttcggacacggtaacctgtcattatcacggtacgctcatcaacggtatcgttttcgatagctctatggacaggggagaaccggccagtttccctctaagaggagttatagccggctggacggagattcttcaattaatgcctgtaggatccaagtggaaagtaactataccgagcgatctggcgtatggagatcgtggtgccggcgaacatatcaaaccgggtagtacgctcatttttataatcgaattattgagtatcaacaaataatcagaagacaaatcactatgaagagagtaatgatcattgccggcttagcctttttagtggccggattatctgcctttgcaaaaaaaccgcccaaaaaggatgaggtgcaaaccgtgaagcctatcgtgacttctgctgactctgtggcatacgctttcggtataagcggagcaataaatttcaatgactataccggacggatgccgggcgattctctggatcgtgccctgattctccgagcattcgaagaagtactcatgggaaagagcactgctatctcttcccaaaatgcggacgaaatgatcaagaaatacttcaaggaagtacaggacagactcaaagccgaaaacttggcagcaggcaaagcttatcaggaagaatatcgcaagcagccgggcgttaaggctaccgaaagcggtttgttgtatcgtgtcttgaaggaaggggaaggacctcgcccgacggttcaggatacggtcgttgttcattatgtgggcaagaacattgaagggaaagaattcgacagctcttattctcgcaacgagccggcaaagttcagcctcctgcaagtgattccgggatggactgagggtgtttgtctgatgcaaaagggtgccaagtacgaatttgttatcccgaccgaactgggatatggcgaacgtagcatgggcgaacttctcaagccgaactctacgcttttcttcgaagtagaactactcgaaatcaagcctttcgtagagaagccggcaaagcctatcccggcaaaacctactccaaataagaaaaactaacgataaaaaacataagggaaactccaaatgaaaaaaacaattgcaattatcgcctcagccctcttggctttaggagccgtcggctgtaagaaaaatgctgacactaccggttgtcagtgaaaaggatagcatagccttg

SEQ ID NO: 820 - DNA (genomic), 5860 bp, PORYPHYROMONAS GINGIVALIS; double-stranded, circular
  misc_feature 1...5860
  hypothetical: NO
  anti-sense: UNKNOWN
cgctcgccggcggatccgatcgtgtcggtatcgcgccgaagaaggtggtcgatgcggctttcgacctccacttggggcaggggggcaatacgcacgaagacgcccagacggactcctctgccatagaaaaaagctgacgaatagtggtgacgcggattgtgcaccgcttcatagagccggtcggcaaaggaatccgtatcgaatgccacggcgtccatactgcatacgcggagcaatttccctccgctataatcggcacgcaaagcaaagctcttgcctcccgtcggagcctgccatgtctgcagctctctatcgaagctattgctccgactccactgcaacgaagccatcagccgccaccgctcgtcgaacatgtatcgccctctcagcctgacggcaaggctgcgccgatagcgtttgtcggcggtgcctcggatccggcagctccatgaaagagcggacagacgcttctctccttcaaacatccagtacaaggcttccgttttctcttttcgaccgaagcgtggaacgaaactgccgtagtagtccgcaaaagctctgaccgtccggtccgaaggcagctcccaagcggctctccccatcacgccccactcattgcccgggcggctgtaacgggcaaaagctccccggtaatacgaccaatagtcggcagggatataccgaccgacgagcatatagctgccaccgacggggtgcgtatagcgcaacccattgatcgtccccacggcaccgttggcggctccggcaaattcgccgaacagctcggttccgccctgaccgaagagataggagtagtcggctgagacaagggagaaacgctccagatcggtcagagaggcaataccctgtgtgccgaccgctcgcaacaggcgcaatccgccccagtgcaagatgcaggagattgaaagtcagacggagtcgatcgtccgtatagcagacggaagtgcctgcggtggtcatcgtggcagcgttttcgccgcgcgatctcggcatccgtacgatgcagcccggtgtggtaaatggctttgatggcaccgtcttcggtgacggtggcgtcgatcccctggcgcgaataaaatgccgtcagtgcccatcgtccttgtgcaagagcggtagcggccccgcgcatgaagttgtcctcggcataggtaaacgcacgtcgcagcgtggttccgccacgaggataggcgtaggccattcccatgaaagaggcctgattgacgagcaggccgtatcccatccctattcgatagtctccgagtgccacggctcgcacagcccccttcccttccatgaagaagtgggcggaatagctgtcgaagccctttcgccgcttatcgaaggccggttctccccggtctttggacgcagtaaggcctaaggaaaaacgattgcccatagcgtagctccagcgcaaaccgccaccccacggatcgccccgatacggatgccggctatccggacggtagccctcctgctgctggaggatggcatcggtatgcaccgatacatcgtgacgggcataagacaggatctcgcgaaaagaggcggcagccgactcgctccgcttctgcaccgtcagcatcggccacaagagcagacaggtacgtctgtcccagccggcaatctcactcagcacccaaatgctgtcgaacccctcgggatgagcatgtcggtagagcaggaaacggcggatctgaaactcattgagaaaggggaattgctccaagtcctcccgggtaagggtattgatgtccagcggatgctgcttctgcaccatccaccgttccagaaattcggctccctcgtcctccccgagtgcacctgattctatctgctctgctatgtattcatcccattcgggcaccaccgtctgcccaccgagaggcaaggagaggagaataatagcacaaacgaccgtcagtagaggcttcataccttccggtaaatcctacgctgcttctgctaccacatcaatgcaaggccgccgcgcacgatgtcggatgtcccggtatcgataaagacggcgaaattgtctctcaatgagcaactcagtccgaccctaaggctaacgttaaatccgccctttagttctctcgatgatgaaccgttgttttccgggaaaaagctcgcccctactgcacctcttgcatagagttcgatattcgggttgagccgcttgtgcacgcctgctccggctaaaaatcgaaaccgattctgcgcagaatcatcagaaaaaggcagggatcttttgtcagatacagatctgaatgccgcccaatccaattccgcatagatggatagcagaagcccttctgcgagttgttttacgccccgttcgtagccgacggcaaaagaagccgaagccccttctacgttataattatccagagagggcaatccgattcctgccggatagccgatggcaacgtacaccatctccttttggggcgagaagatgaaatccttcgtctcggattgctcgggtgcagactgtgcctcggcccgaagagccaaaacggcagcaagaaataagaaaacaagggttcgtttcataagatcatttgtgtgatttttcattcaaaacgggacaaaaatacggagaaacaggcactttttccgccaaatccctcggccaatcgagcgattttccccctctttccttttttcgccggaggtttcatgcttatactgctccgatcgataacttttttggggcgaatcctttctgagaaaaagaaagcctgaattgatatagtctgtatctatgaagccataaaaacattcgatgattttttctttgccatgaaaaaagctgcacatatttttgcgaccggaataaaccaaacggcattaaatcactctttcataaaacgccccccaacggatgacaactattggtaggcaggtgagtgcactcaaataacgatataatttcctcagaccgtatatttttggatatatagggcggcaattctctacaattgtcgcccataatatttttatacgagcctgtcccctcccccgaaaacgaccgaactttccttttcggacaaatccgcctctccgaagttcacagaccggaaatgctcggattgcggagcgtgttttcgggaaaagcggcgcgagaattttttcgctgtggcgcgagaatttttcacttcccgaaccaaaacgaaaaagttcccgcgccacgtttttcagagcgtggatagtcttctccaaagagtccgttatccacttttataagaccgctacacaactcgcttgtgcgtttggcatcctcgtagatgtgtgaatacgaaggaagttttgagttgtttgctgttgtttttctatcggttggactctccctttactccccattcggaggtttaagcctccgaatggggagatttttcgtctatttcacgccatagagcacagaagcccgggggcatgcgcttaagattgtaggccatcgcttccagaacactctgtgtatgcgttcgttctaaccctcggtaatcaatgtcttaatagccttacggactgtgtatgtatagtgagaacgtattactaaagcagaaaaacaagcatttgtgtcttaatagccttacagactgtgtatgtatagtgagaaaattaattgaacttataaaatgttcttaatctgtcttaatagccttacggactgtgtatgtatagtgagaattagactctccaattggataccaaacttatcaaagtcttaatagccttacggactgtgtatgtatagtgagtgcagggagttggttcagcaaaaaccccgctgtcgtcttaatagccttacggactgtgtatgtatagtgagattgaggaagaaggagtagaaaagccctatactcacaagtcttaatagccttacggactgtgtatgtatagtgagacaagtattaatgatggtatagctataatgcttagagtcttaatagccttacggactgtgtatgtatagtgagtttttgggtagggctttatcagatgatagcaacgatgataggtcttaatagccttacggactgtgtatgtatagtgaggtttatagagaggggaattaagaagggctgtcaaagtcttaatagccttgtgtatgtatagtgagccaacagtaaaactggcttttggtaaagaaaatcgacagtcttaatagccttacggactgtgtatgtatagtgagcttggtattcgctgctattgcagtgctatcagtaatgtcttaatagccttacggactgtgtatgtatagtgagtcaaaaattgtaaaacttattaagtcatggcgaaacagtcttaatagccttacggactgtgtatgtatagtgagtccgatagaatgggtactttacctcatggtcagtgagtcttaatagccttacggactgtgtatgtatagtgagtacttgagcgactgcaagttacgaataatcccaaacgtaacgcattggcagagaacgattctatttttttcgaaaatacaagttgagaaatgcagctacaacactatttttgcagttgagttgattatatctcattgatatacaatgagatttcttgattttccgttttcgaaaataagaaagagggagccttcgttttttagattttcgaaaaatagagaaagacaccgtttgataatcaaacacttacaaatagcgaaaagcctctatttttcgaaaataaaagtcccaattctccttttctcctattttcgaaaaacaggagaaaagagttgttcttgcaaccgactgataatcaatacgtcaaagagcgatgtgaggttcgatttttttcgaaaaactaaaccacaatacttttcctttttctccggctcttagggagggtcggatgtccgctcatccaagcagcggtgtaacaatgctgacagagaggaagaaaaaacaccttgtctctcttagctgtctgtgaggtaacagcctctaccaacttgtccattgtcagctctcgcaggctgcagatgaataccgacttattgatgcgtataccacactgctccaatatccgtgcaaccttacgtcttcgcctgttggaggatatgtcgtacgcaaccagcagttttttgtcattcatagcttttcccgctctcggtctaccatttaggggtatagaatttgatgcgcttcaccttgccacagcaaaaagcactcacatctttggtttgcaacttcataatatcggagaaaagcttttccccggatcgatagtattcggtagcaaaccagcgttcgtttatcttcgatataatgcgactgcgtgtaggcatatccaacagccctttgctattctgccccacatcttcccccttggccagtagggccaggatgctcctatcgacgacaaaggcccggtattgctccatgagatcgaaacacagggccggtttattgtcttgcgtgctgtgcaggataccgatattcgggttgagctgccaaaggactattgtcttcatcacatagctccggaggatagcgtagccatagtttagcatctgattgaccaatccctcggctcccttatgctctctcccttcaaattcatgcccggagcgatgcaccagcagggcaaatgccctccaatagacttgtgcgcagcgggcttcatgaagcatggcatgctgtcggaagtccgcaagggagctgccctccgctatgggtataccttccagctgctttagctcggcgatagcgttggagagaggctctttcagctctttgtcatggcgataatacttatgggtagtagcgcaggagtttgccctgattggcgaaaccttggttctttgataagagtaagggat

SEQ ID NO: 821 - DNA (genomic), 2077 bp, PORYPHYROMONAS GINGIVALIS; double-stranded, circular
  misc_feature 1...2077
  hypothetical: NO
  anti-sense: UNKNOWN
aggtaatcttcccgtgcccctacacttgcgtaatgcccctacccgtctgatggccgaccttgactatggcaagggttacaaatactcgcatgattttccggaacacttcgtctcacagcaatatctgcccgacaaagctgctaacacctctttctggacacctcaaatgcacacagtgcatgaagccaagctgggagaacggatgaagcgatggtggaagagggaaaaatcccaaaaggatacagcagaataatgactcttctttccgtaccgtctctatgccgacagatattttctccttcaaacaattcgacatcgaccagacaggttgtgccatgcgcgtgggtaccgacggcgtcctgctgggagcatgggccggagaggatgcagccggaagtattccgcagcattgcctggacataggtacgggcacagggctgattgccttaatgttggcacagcgattcccacaggcccgggtgcagggaatagaaatagatcctatcgctgccgaatgtgctcgcgcaaacgccgctgcctctcctttttccgatcgaatagtgatcgcttcgggagacattttggattcatcgctcgaaagccttatcggaaatcaacgtttcgatctgatcgtctcgaatccgcctttcttcaagtcttccatgcatgcccccgacagacagcgcaccatggcacgacatgaagaaaccctgccgttggaaaaactgatatgccgtgcctccgaattactctctccacaagggcgattggcactcattacgcctcgcgaccggctgaaggatttacgtctgtatgcagctacctatcgttggtttcatctcgcctgacggaagtgcgtaccctaccccataaagaacctaaacgcctctaagcgaatggcgacctgccgatactgctatcgaccgatcgccattcaccgataccctcatcatacatcctgccacaggctactattcaccttgagtacgtgcgtctgacagagcctttctatacgactttctttccgcatcctcggctgtaggataaccgagctgctcccgatacttggcaacggtacgacgagccagtcgataaccgttttcggccaaaacatcagccaactcggtatcattcaggggagatctcttatcctcggagtcgatggcttcggcaagcactcgtttgacctcacgtgtggacacttcctctcccttatcgttgacagtgccatcactgaaaaagtgcttcagcgagaagattccgaagtcggtctgtacatatttgctattgctcacccgagagatcgtactgacatcataacccgtcggatcagccacatctttcagaatcataggcttcagatcggcaagttctccacttcggaagtaagcatcctgtagccgtactatggcctccatcgtccgctgtagcgtttcccgtcgctgacgaagggcttcgatgaaccattgagcttgatccactttctgcttgacgaaaagaagtgtttgtttgcgttcgcgtgagcggtttttagcagagctttgataatcctgcatcatctcctgatagaccggactgacgcgcaagggctgaatatcacgaccacgagtaagcgacacgaccagatcgtcccccatgcgctcgacgatgaaatcgggatgtaccctgttcatggctgcttcggcgtcatctccccatccgttagcgggtttgggattgagctgcatgatcagttcgaaggcctccttcatttccgaatcggaaagggatgctccctcctgcaactgctcgaaccgtttggagacaaagtcgtcataatggttcgtaagaatatggagggctgtctgccgagctgtcgtatccggcaatcgttccaattggagcagcaaacactctttgaggtctctggcacagataccggggggatcgagactttgtaccaatcctatcacttcttctacttcctttttgtccgcctcgataccggcacggaaagcgagatcgtccagaatctcctccaaatcacgatgcaggtagccatcttcttctatgttaccaatgatatagggagcaagct

SEQ ID NO: 822 - DNA (genomic), 694 bp, PORYPHYROMONAS GINGIVALIS; double-stranded, circular
  misc_feature 1...694
  hypothetical: NO
  anti-sense: UNKNOWN
tcgtgcggattgaggcacactttcttttttatgtataagcataaaggtacgcctgactcttttacgaaagattttgccagtaacctcttcttaacgtcagttcgacgtaagaaaacaccaatgaatttgttttttgattagggttaaacgcccaaagaacgtgggcattatgcttgaaaaagtagcgaattatttgtatcttagcagttgataatcaataagatacgaacgaacaaaacgctactttatgaagacaaatatagttgatgttttttgcatcatagatgatttctccaagctttttgatgaagcaatcaagaaaaagaccctcgaagaggcagacaaaaaacgcaggaatagaaagtttaagatgtcggacagtgaggtcatgaccatcctgatcctgtttcatctgtcaagataccgagatttgaaagctttttatcttcaatacatcacctattcttgtcgatccgagttcccacatcttgtctcttataatcgctttgtggagctgcaaagcagggtgggtttcaagctgatagcatttctcaatatgtgttgtttgggtcaatgtacaggcatctctttcatcgattccaccccactgaaggcttgtcatatcaaacgagctcatgggcataggacaatgaggggatgggctcaaaaaggcaaaagcaccatgggttggttt

SEQ ID NO: 823 - DNA (genomic), 4659 bp, PORYPHYROMONAS GINGIVALIS; double-stranded, circular
  misc_feature 1...4659
  hypothetical: NO
  anti-sense: UNKNOWN
gatcatgggtcgtcgttcgttcgagccggcagcgcgtactttccttcgctcctttgccaatatcgggggctttgtgctgctgatcgtcatcattatctccacattgggtttccaaccggtttcgctcgcggccttgctggcttcggtgggtgtggctgtcgggatgggtctgagcggacagcttcagaatctggccggcggtctgatcgtgctgctgaccaaaccgttcaaagtgggggactacatcgtctccaacaatgtggaaggggtcgtggatggcgtgacgcttttccacaccacggtaatgacgttcgagaacaagtacattttcatccccaatggcttactcagcagcaatgtgatcatcaactacagccgcatggcggtgcgtcggaacgaatggatcatcgggatcgagtacaacgaggacttcgatcgggtgaaaacgctgctgctgcgtctgatcgatgaggaaccgcgtattatcaaagaccccctccccaccgtggtcttgaaggaattggccgacagctctgtgagggtgatggcacgtgcgtggtgcgcgacggacgacctgtggaatgtttactgggatataaacgaacgaatctatagcgaattcaatcgtcagggtatagcattcccgttcccgcagcttacgatacacggatccgccgccgggcaggagcgaagagggaaaagtacggaagctcaatcgccggagaacgtctccaccaatacctccctgtaagagttgaagatcttggatttggacacgaatccgagataacatccctgctcgtctatgacgggcaggttccaagccttggtgtcgtcgaagattcgcatgatggtctccatggacatcgtattgactattttggccggaggagaaaccatgaagcggctgaccttgaatctctcatacagctccggccggaacatgatattgcggatattgtccagcaataccagccccatcagcaggttgttctcgtccaggacggggaagacattgcgatggctgataccgaacacgtgtacgacatctcccagagtcatatcgggtctcaccggttcgaaatccttttctatcaccgcatccaacgtcataagcgtcagcacggccttgtctttctgatgcgtcagcagctttcctttctgtgccaaacggagcgaatagatgctgtgcggcatgaaaaggcggatagtggcgtacgaactcgtactcacgagcatgagcggaaggaaaagattgtatccgccggtcagctcggcgatcaggaaaatacctgtcagcggcgcgtgcatgaccgcggccatcactccggccatgccgaggagagcaaagtttttctgtggcagatagacctcgatgaagggaaagaagttcagcgcataggcaaagatgaatccgctcagtgcccccatgaacagactgggcgcgaaaagtccgccgcagcctccgcccgaattggtggctacggaagcgaacaccttcgtgatgatgataaatccgaggaaaacgaacagcacccaataggaattggaatacggctcgaacaggctgccatccatcaaagagctgtactggccgccgagcagggcgttgatcgtatcgtagccctcaccgtatagcggagggaaaaggaagatcagaccgcagaggataaaggccgatatgaggtagcgttggcgatagtgtggaaagttcttgagtttgctctcgaagacgaacatgaccttggagaagtagaaagataccagtccgcagaatacacccagtagcagagcataggggatgcgatccatcgaaaaaggatcgttgagcgtaaagctgaacatggctccctgccccgtgataatataggatacggcggcggcactgaccgagctgatcagcagcggcagcacggacgacatggtcagatccagcaggaggacttcgatgacgaataccaaccccgtgatcggagccttgaagatccccgaaatggcacctgcggccccacaccccacgaggagcatcagcgtcttctgctccatgcggaagagccggccgaggttggagccgatggcagcccccgtcagtacgataggggattcggctccgaccgatccgccgaagccgatcgtaatggaactggctgcaagcgagctccacatattgtgcggcttgatgcggcttttgcgctgagagatcgcaaacagaatcttcgtcaccccgtggccgatgtcgtcccgaaccacgtagcgcacaaatagccacgtgatcaaaatacccacgacggggaaaatgagatagagatagctcgtttcgcgaatgcggtcgaatgcgaagtgctggatgatgtgtatcgtattcttgagcagaacggcggcaaaagccgagaggataccgatgatgaggctcaagatgatgagaaaaagcctttcgtttatgtgcctttcgcgccaaaggaggaagtgcaagaaccacccgtagcgactcgtttccttatccttcatttccccaatcctttaaaaatcgtttggcaagtatataacagtacttctatatccagcctgaggctcatattctcgtagtacagaaaatcgtattgcaggcgttccagcatttcatccggagtggaagcatagccgtatcgtaccatgccccaggaggtgatgcccggacggacattgtgcagcaggtagtagtagggagcacgctccacgagctgccggatgtagaaagcccgttcggggcgcggccccacgaagctcatatcgccccgaagcacattccagaactgaggcaattcgtccatccggtatttgcgcaagatgcgcccgatgggcgtgacccgcgaatcgccatcgaagctgagactcgggccgtccttctcggcatcgaggtacatggtgcgaaacttatagatcgtaaacggccggccgtgaagtccgatacgctcctgtccgaagaagacggggcctctcgacgaacgcttgaccagaacggcgatcacggcatagaccggaatcagcagaatcaacatcaaaagggagaacagccggtcggcgaaccacttgatgctcttggcgcattcgctcatgttggtggccgtcatgtccaccataggctctcctttcatcccctgtacatttactttggctccggcgaaaagcatgctgcgcatcggcacgcataccggcatatggaagggatagagctggtaaaggagcagactgatgaagctggcatcggggcaatccacggcgaggatgatctgatggggcttgctctcttgcaccgcttcggcgacaagcgtggcaaaggacttgagcgactgctcgaatccctctctcgtcgtcggagggacgaagtggagccgcgtggtggccatgtcgtttacggacttcagccacgaagccgtctcttcggctatcgtgccgctcccgatgagcagcacccgatgataaccttttgtcttttttcgctctttgatgccgaaggtcgtcacccatagacgggggaaatatacccaaggcaacacagtcgccaccatcataaagaagagccgcaggtagagcgccgtgtcgtgtacgatgtcgtccaccacgagcagcagaaagacgacgacggatccgaccagcaccgacgccacggtcgtcagcagttcggatattcggcttttggctatgggtttgttgtagtatcccgagagggcgaagagagagagccagaaaagcagatagaggatccccacccacaggctcttggcgttgaagagatattcggacagagtggagtatatgcgctcttgctcttccgtgaggtaacgcagcgtattgtagctcaaataggaagccacaataccgaagacatctgccagcagatagcgcaggcggtgtagctgcatacgtgtcattggcggatcacctccacttctccccttgtgccgagtcgaatgatcgaagaggcctgaccggccggctcttcgcgccggcactccactatataatccacaccgtctaagatggccggagcgatctcgccgaaagtccgtgccgagggttggccgctgatattggccgacgtggagactatggggacacgcatcagtctgcatagctcggcagagaaggtttcacgcgtcaggcgaatgcccagcgatccgtccgaagcgatgagtgccggcgccacgcctttggcctgaggatagatgatggtcagcggtttggtcgtcagctcgatcagatcccaggccaactccggcacttcgtccatgaggccttggagcttcgcttccgaatcgatgaaggaccaagcatgctctngctgtccgctctttctttcagccggtaaatccgctggacggcttcttcgttcgtggcatcgcagcctattccccaaatggtatctgtcgggtaaaggatgattccgcctttgcgcatgacttcggcggctttcttcgcttcacttctctgaatatcgttgagcatatcgatgggtatatctctattttttcgagagagccgagtgcgctcactccttcacgggcaaaagtatgaatatctgccgtatcaatgctttaatatgtcatttcttagtcttcatcggttatttctgtctgtttctttattttataaatgatcagttccggccggagaaagttt

SEQ ID NO: 824 - DNA (genomic), 3515 bp, PORYPHYROMONAS GINGIVALIS; double-stranded, circular
  misc_feature 1...3515
  hypothetical: NO
  anti-sense: UNKNOWN
gagctcggtaccctgccacgaacgcgcatgtagcgaggcttattagccgtagccaataaagtgagcatacaaggaagctctacttccaaaacctcatgtccttcttccgtgctcttgcgaacagtcagagtttgcttgccatcgaatgtggcttcttccacgtatgtgatctgtggcaggtcaagttgctcggcaatctgaggtcctacctgagccgtatcaccgtcgatagcttgacgaccggcgataatcagatcgtggtcgatctttctcaaagcttgagagagtgtgtaacttgtggccaatgtgtcggctccaccgaacttacgatcgctgacaaggatggcatgatctgcacccatggcatatgcttcgcgcaggatagcttctgcctgtggcggtcccatggtgatcacagttacgtgagcattgtgtgtgtccttgaagcgaagagcctgttccaaagctcccttgtcatcggggttcatgatactgggcacaccgtcacgaatgagcgtgccttttacaggatccaatttgatttcggtagtatcgggtacctgtttgatacaaacaacgatattcatagtctaatgcttgattattttaataagttggatgcgattaccaagcgttgaacttcgctggtaccttcataaatctcagtgatcttagcatcgcgcatcatacgctctaccggatactcacgagtatagccatatcctccgtggaactgaaccgctttcgtagtcatatccatagccgtttcggcgcaatagagtttggcttgagccgactccatcgtatagggcatcttcatgtccttcttccagcttgccaaacgaaccagcaaacgagatgcctgaatacggcattgcaagtcggcgagttggaattgcgtgttctggaattgtgcgatgctgcgaccgaattgtttacgctctttggtgtacttcaccgtctcgtccatagctccctgtgcaataccgagggcctgagatgcgataccgatacgtccgccatcaagggttttcatggcgatcttgaagccaccgcctacgcgaccgagaagattctctttggggacgatacagttttcaaaaataagttcgcatgtagccgaaccacggatacccatcttaagctctttctttccgatagagaacccgggagttcctttttcaacgatgaaagcggtgataccacgtgtgccctggctcttatctgtcatggcaaataccacgtatacgtgagcatattcggcattggtgataaaaatcttgttaccgttaagtacgaaatgatcttccttttcttcagcaaaagtttgctgagcagcagcatccgtacctgcattgggttcggtaagtccaaatgcaccgatccattcgccagaacagagtttcggcaaatacttcatcttttgttcttctgttccattttcgtagatgggagctgcgcacaaagatgtgtgtgcagagagaaccacgcctgtggtagcacatacacggcttagttcctccactgccattgaatacattacgtttgtaccgccggcaccaccgtattcaacggggaaagggatgcccatcagtccgatttcgcccatcttctttactgtttcgatggggaaacgttcctgctcgtcaatttctgccgccagaggttttacttctttctcggcgaaactgcggatcatctcaagaaacaattgttcttggggtgtctgagaaaagttcataattcttgaagtttatttggtttgtagtgatactaaaaactcttttattgttgcatcgggatgatctcagaagcaaaagtcaatgaagcttcagttgcagcttgtacttgttctgctgtaaaatccggatgtatttctgttacgacaaggcctttttccgggcacacttcgatcacacacatttctgtgataatcaagtttacttgtccttttgccgtaagtggcaaagagcattttttcatgattttggggttacccttggcagtatgctccatagctaaaattaccttgcgggttcctatcagcaaatccatggctcctcccataccgggtgctttcttgccgggaatcagccagttggccaagtctccattttcgtctacttgcagtgctccgagtacactaacatccacatgcccaccacgaatgatggcaaatgaggtagcactatcaaatgaagcagcccccggaatagccgtaatggagcctccccctgcattgatcagataaggatcttctttgcctgtttccggagcagggcccatcccaatcatgccattttcagactgcaaatatacttgcactccgggttttaggtaattgggcaccatcgtcggcagacctataccgaggttgaccacatcaccatctttcaattcgagggcaacacgcttggcgatcacttctctgatttgatctttttccatgatgaaaaatattttatcgatttctatttgttattcattctcttatgaaactcctgagcgatgaatgaagcaacatcatcagcatatgtattggcaccgaatcctgcatcatagccaagctctttggccaattcataggtgatacgaggccctccacaggccaagatcatcttatctctcagaccttctgcctccatgagttcgaccagctctatcagattcttgatatgcacatctttttgtgttactgtttgagataccaaaagagcatcggcattcagttcgattcctttggcaataaattcttcattcggaacctgactgccaagattgtatgcttcgatcatttcatagcgttccaaaccataatggccggcaaagcctttcatattcatgatggcatcaatacctaccgtatgagcatcagtgccagtactggctccaaccactactatctttcggccgatattctcacggataaagtcatccgtttcagccatatcccatttagtagattctaccttcggcacatagatagagctatagtctaccgtatgttcgcagctgccataacagttgaaaaaagtaaaaccttctgtcagttcgcggaagaacactacttgaggattctgcatccccattttcttgatgagctgcttggctgcttcgatggcttcatctccggccggaacaggtaaggtaaaactaagctgcaccttaccgtcgttcatcgtgtcgccatagggcttgatgcgcgacagatctaatgtctgatcgaaatctcttccttctgtcgaatatagtccaccgctcataacttaccactcatattaaagtttttcatcagctcgattgtcgggttgtagtagtgtaattccttcttggcaacaccgctcaaaccttttcctccgttcatcgggcgttttacatcaccaaaaatacctttttccaaagcagagaagagaccttcttccttcaatctttcaagcaaattcacggtcttgtcaagcacttcacgtgctcggctctgtacgataccgccttctttgaactcaacttccgatccg

SEQ ID NO: 825 - DNA (genomic), 2630 bp, PORYPHYROMONAS GINGIVALIS; double-stranded, circular
  misc_feature 1...2630
  hypothetical: NO
  anti-sense: UNKNOWN
tacgaattcgagctcggtacccggggatagcctgtaccggcagagtatatgtgtgggagataagatcctctcccattgttcgggcgaatcatatttgaggagtttcgtcttcccctttcttagggaatccacatccctcagggatctccaccaagacccctaagggatccctcccgagaccccttaggggtcccacccgagactcctcagggatcccataggagactccccgggggtctcgacagggactcctcgggggtcttcacggactgacaacttttcattatcatgttaaccctttaacaattattcctatgcagaacttaatccgtcaagagccgggtcatgaagatcggcaagcatggagagaccgaagcatcggtcacggttcacaacattttattgtacttttaggcctcatttagaacgctatggagcaagaaaaacagttgcagacagagtatatcgagagcgacatcaagacgctggaatgggacgagcatattcgccgtcgtcccgggatgtatatcggtaagctgggcgatggcactcatgccgatgacggtatctatgtgctgctgaaagaggtgctggacaactctgtggacgaatttgtcatgggtgccggcaagagcatcgatattacgatcgagaatggcaccgttaccgttcgtgactacgggcgcggtatcccccttggcaagctggtggatgccacttgtaagatgaatacggggggcaaaatcgattccaaagctttcaagaaatccgtcggactgaacggtgtcggcatcaaagctgtcaatgctctctccaccgaatttgtcgttacggtatggcgcgatggacaaaccaaacgcgtacggtacagtcgtgccgaactcttggaggagaccgatcctgtcccttccggtgagccttccggtactgaagtgcggtttacgcccgacgacagtctcttccgcaactatcggtatcaggaggagttcgtcgtttcgatgatcaagaactatactttcctgaatacgggattgtcattcttctacaacgggaagaaattcctcagtcgcaaaggtttggaagaccttttggctgagaatatgacgggcgatgcactgtatccgatcattcacctgagcgatacggatattgagatcgtcgtcacccatacgcagcagtacggcgatgagttctacagctttgtgaacggtcagaatacgacacaaggggggacgcatctgagtgctttccgtgaggccgtagcccgtacgatcaaagagttctactccaagaatttcgaatacagcgacattcgtagcggcatggccgcagctatcagtatcaaagtggaagagcctgtcttcgagagtcagaccaagaccaaactcggtagccgtgacatggggccggatgggcctacgatacaaaaattcgtgggcgacttcctgaagaaagaactggacgactatctgcatatccataccgaaacggcggaggagatgctgcgcaagatccagcagagcgaacgcgagcgcaaagcaatgagcggcatcaccaaattggcacgcgaacgagctaagaaatccaatctgcacaacaaaaaactgcgtgactgcaccgtccacctcaacgatcccaaggcgaaggaaccggagcgtaccagcattttcatcaccgagggtaattcggccagcggctctattactacgtgtcgggatgccaactatcaggccgtgttcagcctgcgtggtaagccgctcaactgtttcggcctgaccaagaaggtagtctatgagaacgaggagttcaacctcttgcaggcagctctgaatatcgaggaagggttggacggcctgcgctacaatcgtgtgatcattgccactgatgccgatgatgatggtatgcatattcgcttgctgatcatcactttctttcttcagttcttccctgaccttgtgcgcaaggggcatgtctatgtcctcgaaacgccactcttccgcgttttccttccgcccgaatccaaaaaacaaaccttcggagccacccccaaacgcggacgcaagaaacaggagtccgatatgcctaagccggtgacggatatatactgctatagtgaggccgagaagcaagccgcgctgaagcagctgggcaagaaagccgatgtcacgcgcttcaaaggattgggagaaatctctccggagcaattcaaggatttgatcgacgaggagaatatccgtctcgagccggtcagcctcaagcgcgaggataagatcaaggaactgctcactttctatatgggaaagaatacgagcgagcgtcaggagtttatcattgacaacttagtcgtggatgaggatgtgctttaagcgatcctcccgatttctcaagaatcaaatatgaaaaagaatatcgccctctttgccggttcgttcgaccctttcacacgcggccacgccgacatcgtcgaacgctcgctggccatattcgatgaggtgatcatcgctatcggcatcaatgaacagaagcgcacgctcttctccgcagaacggcgacaagagcagatagcccgctactatgcttcccgacctgctatcggggtgattacttatagtgggcttacggtcgatctc

SEQ ID NO: 826 - DNA (genomic), 2304 bp, PORYPHYROMONAS GINGIVALIS; double-stranded, circular
  misc_feature 1...2304
  hypothetical: NO
  anti-sense: UNKNOWN
atcgaacagctccgttgggaaaggccctgctccgacgcgcgtgcaataggccttgaatatcccgtacacatcgcccacattgcgaggagctactcccaagccggtacaacagccggcacatatcgtattgctactggtcacgaacgggtaagaaccgaagtcaatgtccaagagcgaaccttgggctccttcggccaaaaccttcttgccggacaaaagggcaccattgatcagaaattcactgtccacgaattcaaacttgcgcagatattttgtagcctccatccagcgttcctccagatccgccagcttgtccgtaggatagttcagggaattcagtatgcgaagatgacgctccttggccaccgaataggcctcttcgaagccgtgttccaaatctccgacacgcaagccgttgcggctcactttgtccgtatatgtggggccgatccctttgcctgtggttccgatcttgccgcttcccttagccatttcgttggcagcatccaacagccgatgcgtaggcataatgaggtgggccttgcgcgagatcacgagacgcttggtcagatcgtgaccgctgcgggcaagagcttcggcttcttccttgaaaagcaggggatcgagtaccactccattgcctatgacattcgttttctcaccctggaagattcccgaaggaatggaacgaagcacgtatttctccccgttgaactcaagcgtatgtccggcattggggccaccttgaaagcgagcgacaatatcgtagtgcggagtcagtacatccactatttttccttttccttcatcgccccattgcaggccgagaagtacatccactttttccatatcggatcaatgttatatgtctgtgttattattttttcttcttgggagcggctttgtccgccgcctttttgagggccgactgcttcttcctgcatttgtcgcatataccatagaggcaaatgatggcctgcctataagagaagcgtggtggtctgagatccttgtcggccagtatcgacttcacatttcgtcggtagtaggtagaaaattgtgcacattcggtacagaaaagcagcggacactgctctgcaaatgaagccatcaagtactgatatttggtttcgggagaaggcaaacgcagaacgatcccgcagcgttcgagcaaggtaagggtattatagaccgtagaaagacttacaggcaagccattctcgcgagtgagatcgaacaagtcgtccggcgtgaatatcttcttcagattatatgcgacttcaagaatgctgtatcgttcgggggtatgacgcaagccgttctccgacacatatgcacgcaatcttgagcgaagatcttccagtgatgtgactatcatctttacaactgccatggcactatcgacaggagctacaaatatagttcttttgaagaagttggtcgcgaggaaacccgattggtttttatcttttcgatccattcttgccggcagagagcaaggcagtgggcgaatcctccttgagaatcggagcaagcgaatcgaacgacagcgtaatctgtatcggccccatggcatagggagcgatctcgtactcattgtagaggaaagtaatacctcgctccgagattccgaaattgtccgtaggataaagatcgcccaaggtaccatagcccatttcgttgaggctttccaaagaagaaaccccttggtctgccattaactgcttccagagcaaatcggtgagagcagcatctttgccctgcgcgatgatgtctttcaaaagaatctgcttgccggtacgcaaatcgaggttgagatatgcaacgtcgccataaccatgactaccgcccatgtatttgaaagcttcgatctcatagaccaagagactgttttgcctgaaaacgaccttgcccgttatgtgatcgacataggcataaagccccaagtccggtctgtaatcgggcttgagcgcaagctcctccttcagcaaaggttccatatccgacaaataggtggaatcgctggcagcagcataagccgacatagcctcggaaggcgacatggatgcatacgccgggccgaacagagcattcaggatattccgcctcaccgaatcggcgatagcgtgaggaatgctgtccgatggatattcaaacaggattttaatatcgttgcaaggcatagtggagtcgcctaacaagtgagtgcaacgctccatggaaatactatcgaaaacgatcctgtcgctttgtttgttcctctctctcttacaagatgaaatctgcagcagggtaccgagctaa

SEQ ID NO: 827 - DNA (genomic), 1202 bp, PORYPHYROMONAS GINGIVALIS; double-stranded, circular
  misc_feature 1...1202
  hypothetical: NO
  anti-sense: UNKNOWN
gagctcggtaccctttcaacttcgttccctactacgccaatcttttcagcccgctcttcgtcttcatatcggttatattctttacgtcgaagctggctgagaagtccgagatcatcgcgatgctttcggccggagtcagtttcaagcggctgatggtgccctatatgttgtcggcaacggtgattgccatactgactttcctgctcaatagtttcgttatcccaccgggcaatgctacacgaattgattttcagaacaaatacatcaagaacaagaaggtacagtatgccgagagcgttcagctcgaagtgaagaaaggggtctttgcctttttcggatcgtacagcgatgccatgcgaaccggttaccagttcagcctggaagagttcaagggcaagcagctcgtctcccgtctgacagcggataggatccaatacgactcgctttataactggcgcattttcaactacaggatcaggcacttcggtaagtataaagagacggtcgagagcggtagcgagatggacacggtaatagccgtccgcccggcggacttcctcgtggcagaggatgatgtggagacgatgacgactaccgacctgcatacctatatatcgcatcagaagcaaaggggcgtgggcaacgtcaagctctttgagatcgaactgcacaaacgctatgcagccatcttctctgcctttatcctcaccattatcggtgcttcgctctcttcacgcaaagtaaaaggagggatggggatcaatatcgctatcggtctggggcttagctttgcctatatcctgtttatgaccgttgccggtacatttgccatcagcggatctttgcctccgtttatggcagcttggttgcctaacttcgtgtttacggtcattgccgtttccctttataaaaaagctccgcgataggcagacttccggatgtaacgatatccacaactatgaaagagaaaatacagaagaatatcctcataaagaacaaacgtgccactttcgattacgagattttggacgtttacacggcgggcattgtattggtcggtaccgagatcaaatcgctccgactgggcaaaggcggtttggttgatacctattgctacttccatcggggagagctgtgggtgaagaatatgtacatagccgaatactctatgcacctatacaaccatgtgctcgccgcgaccg

SEQ ID NO: 828 - DNA (genomic), 1067 bp, PORYPHYROMONAS GINGIVALIS; double-stranded, circular
  misc_feature 1...1067
  hypothetical: NO
  anti-sense: UNKNOWN
aaggaaactaatcctatctaactctcaaaatcaactaaacgatatgaaagtattggtattgaactgtggtagttcatccgtcaaatataagctactcgaaatgcccaaaggagacgtattggctcaggccggagtggaaaaattaggccttcccggctcatttctcaaactaaccatgcccaatggtgagaaagtggtgctggagaaagatatgcccgaacatacgatagccgtagagttcattctttccgtgctcaaagatgacaaatacggatgcatcaagagctatgaagaaatcgatgcagtagggcaccgtctcgttcatggaggtgagaagttcagtaatagcgtggagatcacaccggaagtaattgccaaagtagaagaatgtattcctttggctccacttcacaatccggctaacctcaaaggcgtcgtagccatcgagaagttgctccccggtattcgtcaggtgggtgtattcgatacagctttcttccaaaccatgccggaacatgtgtaccgatatgccttgccatatgatatgtgcaacaagcatggtgtacgtcgctatggattccacggcaccagccatcgctatgtcagtgcccgtgcttgtgagatcttgggtttggactacgacaaaactcgcataatcacggcacatatcggcaatggagcttccatcgctgcaatcaaaaacggcaaggctttggacgtatcattggggatgacacccgtagaagggcttatgatgggtacgcgcagtggagacgtagaccccggtgttcttaccttcctgatggaagcagaaggcctcgaagcagcaggaatctctgaactgatcaataaaaagagcggtgtacttggcgtaagcggtgtgtcctccgacatgcgcgaaatcgaagatgccatcaagaatggcaacgaaagagctactctggccatgaccatgtacgactacaggatcaaaaaatatgtaggagcttatgccgctgccatgggaggagtcgatgtgctcgtattcaccggtggagtgggtgaaaccaatataccacgagagagaa

SEQ ID NO: 829 - DNA (genomic), 642 bp, PORYPHYROMONAS GINGIVALIS; double-stranded, circular
  misc_feature 1...642
  hypothetical: NO
  anti-sense: UNKNOWN
gcttggcactgaaaggacggtacaggtgcacgctgagcagtccgactttctctcctttggcacggaggaagtctatcacttcgcgaatagcttctgtcaccgaacccatggcaataatcacatgctcggcttcgggatctccgtaatagtcgaacagatggtagtggcgcccggtaaccgtagccagctgatccatataatactgaacagcttcgggcactgcatcgtagaagcggttacatgcttcgcggttctggaaatagatgtcgccgttctgtgctgtgccacgagttacgggcgactcaggattgagagcttgcttgcggaaacgctttacatcgtcccaatcgatgaaccgggctaagtcttcattgtcgagagcttcgattttctgaatctcatgagaggttcggaaaccatcgaagaagtgaatgaaggggatgcgagtacgtagcgttgccaagtgtgccacgccggccagatccatgacttcctgcacggatccggtacagagctgagcaaagccggtctgacgtgcagccatgacatcctgatggtctccgaagatagagagggcatgggaggcaatagtacgtgccgaaacgtggaaaacacaaggtagcaactctccggaaatctctg

SEQ ID NO: 830 - DNA (genomic), 4408 bp, PORYPHYROMONAS GINGIVALIS; double-stranded, circular
  misc_feature 1...4408
  hypothetical: NO
  anti-sense: UNKNOWN
tggcgagaagatgatcttcggtgccaatcgcgataaaggaatcgtattggaaggtctcaagcttcgtgccgttacgataggcgaagacggttacaccctcgatgacgtactcgtgcacgataagtatgagcaggacgtaacgctgcaccatctcctcgcaatgatgggttacacggatgatagtatgcctatcgctctcggtgtcatccgcgacgtggaagcaccctgctacgacagagcggtggaagcccagatcgaagagatccagcagaagaaccccatacgcaagctccatgatctcctcatccaaggagacgtttgggagatcaaataaagcagtttagacgattagtacccaaacgggtaggattcgacagaaacctttcggggaggatgtcgtttcctacccgtttctcttttatgggacgagtgtagaccggttattcgacaggggtcggagattgatcgagtataaaagcagggagccatgccgaaagattgcggtatggctccctgtcagtcagattatttgtgtctgaaatacttccgatacgagaggagggtcagtctttggcttccatacagtcctcggaggtttcgagatttcgaatgcgccaatcctgcggatatagattgttggcacgtgtgccgagatttttcaggaagccgagcggccttctgcggaacgtggcgaggacgaagccgagcggcagatcgggcatggtggtcacagactgtcgggccaggtaggagagagcttcatctcgtgaaaattccatatcgaagaatgagtggtcgtccatttccgtggacaaagccagagccggagccggtacaagatctttccccttctgcatccccactgtgatccctgctgtgtgcagcctgatgccatttgccttgagacattcgaccatttcgagcacattgggagtaagagcatgcacatactcgtctcccatccatcgccattcgtatttttcaggggcatgtacgaagcatttgataccatgagggatatgcttttctgcgtttttcttttccttgctcttgggttgcttatgccttaccgattctctctccggtttgcgaacgaggcagaagaaaaatccttcacccgcaactttatgagggaagaaacggtatgccggtgcctcacctttgagttgaggggcgatctgccattcggtgagaacatccaaagccacaggctccgctccgaaagtatcgatgaggaaggccagattgtcttcgttctcaagcgtattgaaggtacaggtgctgtatgccaagagacctcccggctgtaacatttcccatgcggcagagaggatacgctgctgcctgcgagcacaaagctccacattttgcaggctccattcggatcgagtagcctcatctttacggaacatgccttctcccgagcaaggagcatcgaccagaatgaagtcgaaagtctctcctgcggatttcaacctatcgggatctgcttcggtgacaataccggtcggatagccccacttgatcatgttctcagccagtatattggcgcgatggtggatcacttcattgctgaccaatacactgccttcgggcaatatgttggttaggagtgtgctctttccgcccggggaagcgcagagatccaaagcccggacaggtgattcgccgagcagaggtttcaactgccacaaaaacatggaagaggcttcctgtacatagtagcctccggcatggaaaaccggatcattggtgaaggaaggcctctcagccagatatgtaccgaggggacaccagggcacagacttattggtgggcagatccattacagtggtaccgatgcccggtttattaggattgcgacgtatgcttacaggtgcagggctgtcgagagctgcaaaaaaagcttcggcttcgctccctaacagtgggcgcatagcggagacaaaatcttgaggtagtggtgtcatctattatttatagagtaagaagatagttggaattttatgtagtgcaggcttccctttcttccattccgagagggtacgagtacgaatcagttcgtcgggacaggagatatgggaggcaatgcatagtttggtcgtcggccggcagtggcgaatgagttcgtccaccagtttgtcgtttcgataaggtgtttcgatgaagatctgcgtctcgtgacacttataaatccgcgtctccatttctttgaaagcagccaaacgctcattttctccgatgggcaggtagcctttgaaagcgaagctctgaccattgaagccggaagccatcagtcccatcaggatcgaactcggccccacgagtggctccaccctcaatcccttgcgctgtgcgatggctaccacatccgcgcccggatctgctattgcaggacacccggcttcggagataacccccatgctctcacctgcagccatagggtggagataggtactgacctcctctgccgatgtatgcttgttgagttcgtagaaggtgagcgaatctatatcgatagatcggtctgccgttttcaggaaacgacgggccgaacggatattctctacaatgaaatggtgcaggctgcggacgatcgtcctgttgtattcgggcagtacgcggctgtgctcggtttcgcccagcggtaccggaataagatagagagtgggattgttttccatcataatcgggaaagggtacgggactaaaaaaaggctttttttattcgtgaagattcgtgagctgttcggctaatagtaccgtactgcctcagataaggcatttcactgcggagataagggctgaaagtcagacccgaaagctgctcttcgatctgatccaccggccaccacttcccggctcgcggatccttgtcgcacaagatcgtattcgattcggacatgtgagccaaatagagatagacgagtcggtcttttccattttcattgtggatatatcgcagagaaagtgcggtctcagacgatttacaccgcagaatcgttcgtctatgagactttgagccaattccttgtgatgcttatcagtagtcagccacgaaaagaaaggggtatcatagcagtcgcccgtgcaaagatcgcatttgcagtaatggctcaaatagatcatcccgtcgcatatggctatcaggcgaacgacgggcagcagacctgcagtaggatcggccaaggcttccgtctcggatcgtgctatacgtccgatggattcaccctgtgcatccgtgatcggtatccactcctcgtggtgcatttctctacgtacccattcgagtcgaatcacctcatatatatagagcaataacagcgatacaccgggcagatacaataagaggtgtgcaatcctccccaccctgaagtagagcaaaagtcccagaaggaaaatgaaaaataacgatatacgcaggatgctgcctgtaatgcgtccatactccagcatgaccagacgtttgtgcggacaatccgcatagtctccctctctgccactgcttctgcggaacagcctgcacgcagccacagccaagagcatagcagccagactccagccaaggtcggtgagcggggaagtcttggatagccacaaagtaggtagcaaaagaacaagtacacccagcgaagtcaatacggacggctgacagttcttgctttttcgacgaaaaaagagcatccctccgatgattgcaaagagagcaatggcagccgtccatgccaccattatccccgcactcggcagcaacaggagcaataagacgaccggcagaaatccacccatcggattagaccccaataagggtgctatatccggatacttctttgtagtcaaaatagggattcgttttttcgtttatcagtataacagccatagacccgtttggttgtcatccggcagtacacactgtattatgaaaacgattgagggctgactccgggattcggaaccagcccttatcgtcatacccaaacaaatgtatctatcagatattaagaaaacaaacgggtattgttttccaccaaactcttgatttttccctccagatccggaggcaaagaagcctcggacagcaatcgggctataggctgcaggtgatgtatatctgtccctatgagatcgtaatagccggcctcgagtaatgcatatgctttttctgatgcagatgaattgtatgctccgaacagagaaaagaggttcagttgaaacattacgccttgctttttgatcgcgacataatctttctcctccatgtatagataacgttcggggtgtgccaatacgggagagaggcctttgaatcgcagatcggcaagtagccccattaatcctataggaggagccatataggaggtttccaccaaaatgtaacgatctcccagcgtcagaagcggttctgccg

SEQ ID NO: 831 - DNA (genomic), 407 bp, PORYPHYROMONAS GINGIVALIS; double-stranded, circular
  misc_feature 1...407
  hypothetical: NO
  anti-sense: UNKNOWN
gaagatgctccgaacttatctccctaccatctaggagtttccagtacacagccttcttgttgatcctaatgctcaagtcctgcaatacacctgctccatctgtacctagtgcactgagcagggctcctctgaccaccgctaattcgtgattccctgcttgctcttcttcccgaaggataagcatccttttgatccaaaagtccaagaaagcattctcggtaagcgcatgataataaccgaaactggccatgtgtcggtatttctggaatagtgaatggctcaccttgcgtttggtgtgaatgtcttctaccgaatagaatacaaatacgggcaatggcctgtacctcccctcatctgttgcatacccctctagtagccttttggtatagtcctgatggtctgatgtc

SEQ ID NO: 832 - DNA (genomic), 750 bp, PORYPHYROMONAS GINGIVALIS; double-stranded, circular
  misc_feature 1...750
  hypothetical: NO
  anti-sense: UNKNOWN
gggttccatccttggacaccagacgatcggcgatataaggtttgagaaaagccttgcgccggatctccgccaatccggctgaatcggaaggaatctcttccggtacgatctgctcgatggccatcccctcctcatttccgatcataaactctatgtccgtaagtgaagtaatcttttcggcataggaaatactgtcgagcatctcgttggaaagacgacggatcagctccagattttctttcgtgaaggtattgtcacagtcggtcaatacagcagcatagttatcattgccgaaaacggatttgaactcctccgtcttgatgatcataggatcgtcctcgagaaaatagtcctcccaagaggttttgatactaaggaaacgcaatccattgaatccaagaaggagaaaaaagaaaaaacctcccaatacaatccaacgcttgcggataatccattcgccacgatggcgaaaccacctgttaatgcgttctattttcattgctttgtctcgtttgtgttttctgtattccgtattatagtcatatctgcatcagtgctcgccagccggccgtaccgaaagcgatatattcggacagaccttgatttatctcctcctcggtatgaatctcatttgttattatctcgatgaaaacattgacccaccacgcggcccccaatcggataaagaaggggcttacctcggtgttggcatgtgggtatttttctttgaagagctgcagatagttttcg

SEQ ID NO: 833 - DNA (genomic), 356 bp, PORYPHYROMONAS GINGIVALIS; double-stranded, circular
  misc_feature 1...356
  hypothetical: NO
  anti-sense: UNKNOWN
ttcccagtttgccactgcagaacgcagcagcttntctacacgtgccgaagcttctttgttagagaacttcagcacacccaaggcgcgattcacttccataccacgaatcatatcgggccaccaatctcatcttgcggggagaagtaggcacgttacgaagcttggcaaagtacatctgcttgagggcttcctttcttgcttcggctgaattatgttttcttgcacccattgttcttaatacttttaattgttcagattcctgaagtgtttgtattcaaccgaattacttcttcttgttaccggcatgaccacggaaagtaccgtgtaggagagaactcccctaacttatgcccacc

SEQ ID NO: 834 - DNA (genomic), 5793 bp, PORYPHYROMONAS GINGIVALIS; double-stranded, circular
  misc_feature 1...5793
  hypothetical: NO
  anti-sense: UNKNOWN
gcggctcttcgctttcgtgccgcgtgcctgcggtctgcgatgcatccattccgcttcgcggcgcaggaggttggctgcgcggcttgtttcgcgttcggtggcttccagccgctcttcccgtttgttcaggtagtattcgtagttgcctttgtaggcatacagctgtttgttgtccagctccagtatgcggttgcatacgcgatccagaaagtagcggtcgtgggtgaccagaagcagtccgatctgctgatgcgagaggtagccctccagccattcgatcacgtccagatcgaggtgattggtcggttcgtccagaaacagcagttccggattgccgatgagcgtacctgccagagcgatacgcttaagctccccaccggagagattgtccgtggtgcagtgcagatcgtccagatgcagacgggtgagaatctcccgcgcgcgctgttcgtactcccacgcgccaagggcatccatttcggggagcaactcctccatgcgtttgccgtcgccccgagccgaagcctcctcccattgcgctatcagggaggtcatctcatcgttgtgtccgaagcaggtctccagtacggtactgcccggaagtacttggggaagctgtggcaggtatgcacggcggataccgttttggtagatcacttctccggaatcgggtgagtcgattcccgtaaggatattcatcagggtcgttttcccgttgccgttgcgtgcgataagtccaaccttttcgccccgttcgatactgaaagagaggtcttcgaagagaaccaaatcgccgaaacttttggtcaagtgctgtgcctgaaacatgctgtctttagatgcagtagtggtatcaatccttctgtttgtatgcctgataacgagccattacgctgcgtacatagttgatcgtctccgcacctcgcagatagccggagcgacagacaggatcgttatagtagttagggtctttcttgaggcggatgtatgcctccacgttattgtcccatacgttggggttgcccccgtacttcgcagccaaacgccttgcgtccgccacgtgacccgagccggcattgtaggcagcgagcgtaaacttgagcttttcttccggatccgttacatcgggaaattcgttcttgaacgccaacaggcatcggatggagacgcgtaccgaaacttccggatccagaagttcctgcttgtcggctccgaagcgtcggcctgtcctcggcatgatacccatcaaacctctggcaccggaccagcctacgataccggcattgaagcgcgattcgtggtaggcgatggatgcgagcagatgccaagaccagccgagccgaaactcctctgcatagtgcttgaaaatggtatcgtactgcgatatactccctttcctcagcttgatgcgaggtcggggagcggactgctcctcttcgacctcatcgtcgctcttgctcatctcgaagtatcgcttctgtatggctcggtacgattccttgtcggggatggattccccccatcggttcacccaccgcgccagacaatgattgtccttgcggacgatccattgcagcctttgtccgaagcctactttcaaactgatgtctatattgcggtagtagggtccngnccantcgtgccaactgttcatcggcaaaggtgtagtctatttctcctttggctacctgcgtgatcaggtcttcggtcgtgagggtatctccgctgaggatcagcgaatcgatacctccccccacttcttcgttcaggtgccggagccgatcggcatagcgagtatgtgccatgactgtaacgggcttgccgataagatctgttacgttcgttatacgtggattgccgtcgctgcgttgcaccaatacttgtcccgatatttcttcgggaccaacgaagagatacttctgcttacccttgaaggttgcggcctgaggtgtaattgccatatcgaccagaccggtatcgaccgcagcataaagtgcctcgtcgttgggcaccacttctacgaccagagtcaagcccagagagtcggcgagcagcttggccagctcgtactcatagcccatttcttcgtctttgtacacgaagtaggtggtcgatgatgagagtgtagccacgcgtagcgtgtccgcagagcgcagccccgatacgacagaggagtcgcatgggatgctgtcggctctcccctcttcggacacacagcctcggcaactctgagacaaggctcctacaaggatggaagcggcaagaccgaccatacataaaagccatctgccaaaagattttttcgatatgggcataacgatgataaataccgtattgacgagatacacaggtatctctttgacgaacgaagataacgactttccgataaagcggcttccgaagcctgtcgctttcttcaagagtttctgtccggtcggtcttttcgttacatttgcagagcaatagagatctcctgttaaagccaaatcgcagtatgtcagcgagattctatcgaacgacggtgttttgtattaaacggctaaatgacattagacatgtatccgaactttactctttctcttgatttgtccggccgattgggccgaactcatacgtgcaccgtatattgcttccccaaacacatggatctcggcaacgaataggattgggataatacttccataatagatcaaatgcataaggcacccgctcggttcggccatgaattgagcgggtgcctctttgtatttcaactcttgaaaaggcttttttcagcccgcgatccatatacaaatcatttacgatctatatataaattaaaatcgttttgtatataaattgaaaacgatctgtatatagatcgtaaatgatttgtatatggatcgttatcatgtattgcgatattcgtatcctgatctgaagaagttcgttctatcttctctttggcagccaaaaacacttgcgtttgggtgcttatttagaatgattctaaactcatcttcgttgttgaaaacttttttggcgcatgtttttataccaatggatagtacaagcagggatgattcggtattcgtgccagtagaattacagatcctttccatgcgattcttcatgcttattcgtatgctgatcggacacaaagaagatgaaggggggcacttagaggatagaagggaggggatttgttagggcggatttcaaaaaaataagggctatctcccgacagcccttacttccttattaaccttaaaatctaataccatgaaaaacactgtacaaaaataaggcgatgtatttctcgtgcaactatattaggccaaaaaggcgcatattagtccaatcaatatttgttttcggccttatactcttgttttctcccatattcgaacggggatcatacgccagaaagcgaccagtaaacgatagcgccagtcgaaagtcagcagtctttttcgacggatgacagcctttactattgcttgggcaactatcttggactccatcagcattggatacttaccgtctcgtagcaggggggtatcgacaaatccgggacgaatctccgtaacggtcaggtgtaggctgtctgtcgtggccaattggcgtatggattggagatagtgcatttggaagcgtttggtggcggagtaggcaggagcggatcccattcctcttgttgctgctaccgaactgatggctactatttgaccctttttccgaaggcgaaaatagcggtaggcggcaccgatcattcgggtaaatccttctccattggtacggagggtgtccagctctttcgtttcgtccagttgcggattgttataaccgataccggacgagtggaagtatacatccataccgctcatttcttcgatgaggtgggacagccgttcaggagcatcggaatgcgtgatgtctattacggctgtataaacctgtgagggattctcctgcttcaatgcatcgagcatttgggtattgcggccggcaacacctacgaaccaaccgcgagagataaataggcgggctacatcaagcccgatgccagaggtggctcctacgacaacgattcgtttggcttccatgatttcctgttatgaaatgaagtccatcccacgaagaattttcgcttcttctgtcgtagctcctacgacagtgaaagccttcatctcacgtgggtgcgggtaggctttgcgttgttcttcgaatgtcttcggcgatgcccttagcgatcgatccggtacgagcggatcgaaggtatgcagcaaagccctttcgatacgatggtcggggaagagcgacagatctatgatgggatgagtcggtgggggaggggctaaagtatgcagcaggggaaattccagtccgaatacttccgtaatggcttcaaggcacattctggctccattggcttttccgtctgcagagaatcctgctatgtgaggagtcgcgatgtctgccaaatccaacaggctgaggtctatatcgggttctccttcccagcaatctattacgagggcttggagccatccgcttttgacagcccgaataagagcttgggtatccgctacggctcctcggcaggcattgatcaggataggccttttgtctgcacagctgcgtagaaaagcctcaccgatgaggtgataggtggcgtgagggtcttcatgggtgaggggaacgtggaatgagataatgtcgcactgctccaccagtcggcttagaggaagaaagctattgtcctgctctgcctccgaccgaggtggatcgcagagcaggaactccatgccataggcggaggccaaacgcttcagctcaccgcctacatggcctacacccactatacccattaccttctctttcagggaaaaaccctcgcgcaaagccagacgacacaggcagcacattacatactgcgctacggccgtagcattgcagccgggggaattgcgccagaggataccgtggctttcgcagtattcgcggtcgatgtggtcgaatccggccgtggcagtcgttatcaaccgcacatcagtaccttgcagaagagccggtgtgcacttggtgatactgcggacgatcagcacccgggcatgacgtatcgtatcgggagagaagcagtccgagtgtaggtaagtaatgtccgcaacaggatcgacaatacctctcaaatagggcacggatgcttctgccactattttgagaggaccggatagagaggaaagcatttcttaggcttcgccttttattttggttgggaatgtaaatgtggcatccgatacgcgttgctcggtgtggatctcgccgtgttccacttcgtagcgatggatattgtccgagagagtggtcaaaagtcttttggcattgtccggagtcaggatgatgcgattttggactcgtgcggtgtcacgattcggaaccatacggatgaagtccaagacaaattcgctcggagagtgcatcacgatacagagattgcagtagttgccctgagctatttcttcgggcagttcgatgttgattgttttgctttcgttttccatttgttcttgaatgttttaataagtagtatgagggaaagtgccaagctgaataacgtatggcaccgttacccccttttgaacaaagttactcctttcgtctaaatgtgaataagggttcacgtgccacgagtgaaattattgcggttcgaattacggataatgctcttttcccatccggtacaaatataccctgtacgaaatacgctctttttgccgaggcatactttgtacagggtaagtaagcatgtcc

SEQ ID NO: 835 - DNA (genomic), 6360 bp, PORYPHYROMONAS GINGIVALIS; double-stranded, circular
  misc_feature 1...6360
  hypothetical: NO
  anti-sense: UNKNOWN
tggagcacaacccctgctcggtcatcgcggttgccgtctgggtaatacctatccggagattacggagatgcagacacgtgccatcctcggtgcttgcttggagctgaagaaggaaggtgtagtctgtctgcctgagatcatggtgcctctgacggggatcctccatgagttcaaacatcaggaagaggtaatccgtgctacggctgccaagctgttcgaagagaagggcgacagtgtggaattccaagtaggtacgatgatcgaagtaccgcgtgctgcccttacggcggacagaatcgcctcttcggccgagttcttctcattcgggaccaacgaccttacgcagatgactttcggttactctcgtgacgacatcgcttcgttcctccccatctacctcgacaagaagatcctgaaagtggatcctttccaggtactcgaccagaaaggtgtaggccagctcgtaagaatggctacggagaacggccgcaaggctcgtcccaatctgaagtgcggtatctgcggtgagcacggtggtgagccttcgtctgtgaagttctgccatagagtgggattgaactacgtatcctgctctcctttccgtgtgcctattgcacgattggcagcagcacaggccgttatcgaagaaggcaaataagaaagaatacgttagtctcttcgactcgtatgaagaggctgacacctatcggtttattggagaaagagcaagtccgattcgtcgggcttgctctttccttttttgtccccaatctcggttcagaggcttatcctgaacatacagtcattcctctttttggggggcttgatccgaaaaggaaaacacaaggatcgttaatagaatttattttctacagttcatccagcataaaaactacaaatatgtggggagatgggaaagaaaaataccaatcggtcggtattgtacgaggtgcgattatcatagtcctttgcaatgatttctcggaacacctttaattgttactcattatgaaaaaaaattttctttttttctccctcgttttagcagccatcatgtcgttgctgtcatcttgtgccaaggatacgccggatgcgcccgaacagtacgctatcactatccgtgccaaactaccggaaggcagtacgatagagagtctcgcaggtatagccatcgaattcctcgatcttcgtacccaacagaaagtggaaaaacagctcgacaaagccggtgtttgctctcttagtctggatgccagtgtatatacgattacgatacgtggcgaaatagggaacaacagtatcgttgccatcaaggaaaactattccatcgcagagaatactaccttggagcttccactcattgtgacgaagatccgcccttccggtctgctgttcaaagaagtatttttcaatggagagaccaacaacgggcagatgatgcacccggatcagtacttcgtcatatacaataatagcgataaggtggtctatgccgatggtgtcgctttcggtcttgccgcacatgccaacgtaacaggtgaagacgctttcaccgaggagttgaccaagaacaaccgcatcgtcctttccatgatctataccattcccggcaacggttcgcagtatcccatccaacccggtggtcagctcgtgatagccggaacggccatcaatcaccacgatgccgagcatccgaattccgtggacttgagcggtgccgatttggaagtctatgagccggatcagcccgcaaacttcggacaggatgtggacaaccccaatgttcccaatatggtgaagatatttaatcgattcggtgttttcatgatgcatcccagaggatttatccctcctgttcttttcgagatagatgagccgatcgagactttcctggccaagaaccagttcgagtacacgaacaatgatggagagaacattatgctctatgccgttccggtggaaaatgtgttggatggtatcgagaccgccaataccggtaatatgaaagtcaagtccctgcccgtgacagtggataagtccatgatcggtgtaccgggttgccaccgtggcatactcattcttcgcaagacggaagaaaagaatggccgtacctatatgatcgacaccaacgactctgaaaatgactgtatagcccgtcaaggacaaaactcttttcctgcaagattctaatagaaaagtacattagtatatctctgaatatagactccgaattattcttaccccgatctgtgcagacagtgtcagccctcaaaagggcgactgtctgcatagtaatttgatacgagacacctcctctgcccagatcgcagtcaggggctcgaatacaattccgatgatcacatgaaaaagaatggactttcttacatccccgtattgcgtgctttattgatctgtacgcttttgctgctcgcgtatggagcttcggctcagcatcatgtgtccacttgtacgatccgtggtaaggtgacggatatggcgggaaaggagggcattggttttgccactgtactattggcggatcaggcttatggggtagcctgtgacgggaagggagagtttgtgatcaaacgggttacagccggatcgtaccgtgtcgtggtcagctgcatgggctttgcttcgttcgagaccacgctccatatcaaagcagacaccacggtacacttccgactcaaagaacatagtatcgctctgaaagaggtgcaggtgctggccacttataagaacaagacggacggcaacgtatcggtggatcggactgctctggaacatatccagcctacctccctgcgcgacatctttctcctgcttccgggtaatgtggtgcaaagcaacagcctgaccggattcgtgggaacgacttctcgacaaataggcagcgacgataatacctctttgggaaccaacatctccatcgatggtatgccgctttcgaacgatgccatgcgtacccaactgtatggtatcacgggagtagatcggtctgacctgtacgttgcggatcgtaccgttactcgcaggacgggaatgaatgccggtatcgaccttcgtaccatctccacagatcatatcgaaaccatcgaaatagaacggggcatctcatccgtaggggaaggtaattttgtcgagcggagccattcgcatccgtaccaagcaagggtctgctccacttccaaatgcgtgtcaaggctgatccccttagcaaactggcctatgtggggaagggattcaaagtgtccaagcgcggggcatccattcatacgggaatagacttcctgcacaacaaacccgatgtgagggaggtgttggatagctataagcggagtacgctgcatgccagatatagcgatcagttgaattacggggatatgatcgtggacttgggtatcgggctgatgcagaccttttccattcaagacagcaaatcggatcagctcgtcaatgagtatgaagagacctacaactccaagtatttgcgttcttctctttccttcgatgccaaagtccgcttttcgggtagttggctcaatagtatagactggcttctctctgccgactatacttccgatctgctcaaaaggaagaaatactacatcagtacgagtggcccgaagagtatgcccgtagctaccgaaagcggagaacatgaaggtgttttcctcccttcggcctactatgcctactatgaaatagacaatcagccgctctatttcttcagccgtttcaaagccaataccgatataaacttcaccgaacgtcatcaccatcatttgctgtacgggctggaagctcgcagcagtaagaatatcggtaggggagtggtggccgatcctactcgtccgccttatccgggaaacaacagctatatccgccctcgtcccaactataatataccggcttcggtctatgctgcattctttgtcgaggacagggcttctgtcgaatggggagccaataggctgggtattcaggccggactgagggctacgcatctattcaatctgccttcgtcctatgccctctctcggaagatgctgatagagccgcgtatcaaggccaactggcagtacagagccgaacatctgtcgataaacctgcgtgccggatacggtatggaaaacaagttgcctacactggatcatctgtatccggacaagatctaccgtgacttcatggtgctgaatgcctatatgcagaatcccgaactggatcatctcatcacttatacttatatccacaatcccgagaatcctgctatcagggagaaccgcaatgtcaaaaaagagatcggcatagatatgacgtacaagcgtttcgacttttctttgacactcttccacgaagaatcgcgacgcggtttcgagtatttcgactcctatctgcctatagccttcgaccgctataccaagctgatagcccctcttcctccgggacacaaaccgcagaaggaggattatattcaggagcatcacaaggatttctttgttatccccaccgtgcagaattctgccaaagtagtcaagcgcggtatcgaatttcgtttgcgcacaccttatctgaaagccatcaatacccaagtcgaagtcaatggagcctattaccatacgctctacgcttcgggtatccctatcatgttccgaccgatagtgtcggagtacgagcaggctctctatccttatgtgggctattacgaaggcagtctgcacaaacactaccaacgcttcaatacgaatgtttgggtcaatacgcacttccctcgttataaactgatcttcacttcctttttccagattatctggcacgatgcctcgtacagggggcatgaggagagcgagttcccctatgcctatatggatctcgatggagtagtccatcccacgagcaaggctgccattctggaggctgctgccacgaacgatattctcaagtacttgagccgagagcggacggagctatactacagggctacatacaaacccatatcgctgcgtatcaatttcaaagccaccaaagagttctccgaccgtatgcggctggcttttttcgtggacaatatcatcgacatcaatcccaaatacaaacaggccaataatacgacggagcgagactggtctataccctatttcggaatagaaacgacattcaccctatgaaaaccattgtaagatacagccgccttccggtcgctctcttcttttgccttttgggagctgtgcacttgtctgtcgaggcgcagatgctcaatactcctttcgagctgtcggatcagatcgtcctgtctcccaccgaaaggcaatacagggagatttgtgtgcaaacgaaagaaaaaaggggggccgatcttttcccgttgagcgataagctgcgcgattcggcctatgttcgtttcggctcggcctatggcgatattgcgggcgactatcttccgtacaacggcaataactactcctcgctctcgctcgaatcgggtggtcgcatcagtgtccgtaactatggcacattgcagggcagtgcttcctactcacgtggcatgcacaaacgcatcggctggaatgctctgcgcaacgccgaagcctactatccctatttggtgtccgattcgaccggcggagactatcatttcgaagactatcggcttgccggctactattcttttcgcgccggccgcttgcccctcggtataggcttctcatacaggggcgaagttgcttatcggctgaccgatccgcgtacgaccaatacgaccggtgcattggagctttcttgtgctacctctttgacgctgcctcgagagaacaggctatcgctttcggctgcgtatctctatcatagacaacacctcacacagtacaactggcgtcccgggcagcaggacaaattcttcgtcagctacggtttcggtcaggtggatgtcagcaacagccctatctggttcggtatctccagaatgaactacgtcaacggatggaagcttagctcccgtctggatacccgtaggggcgatgccatcggtctcgactacagcggctacttcctcgataccgaagagaggtcgtccatcaatctctttgctttgctttacaatcgcctgcgactctatggtagctggcatctgtcggacttcgatttttcatttttcagccgactatgctctgcgccaagggatagagcggatatacgaagactacaagccggatgataattatcatatctacgacctccgtatcttggccattcgccgctggtatatgctcaatgagttttctggccaagcccaagccttctaccggattcgcacggatagaggttgtgccctgagagtgagtgccggtagtgatt

SEQ ID NO: 836 - DNA (genomic), 1081 bp, PORYPHYROMONAS GINGIVALIS; double-stranded, circular
  misc_feature 1...1081
  hypothetical: NO
  anti-sense: UNKNOWN
ccagatgaagcccgagaaggtggctccacgagatacgaaagagaagttcgccgtttgtggcgttcccgaagagtgggtacctgtactgcataaggccggctatcttaccgtacagtcgatgcgagaggataaaccgggcaaggtgatgcagcagctgatggacatcattaagaaatataagttggggcttgccggtttgaatctggaaaccgtttcggcttggcaggaagccccatatgagtaacgattgtacaaggatagcggtgcgaataggaaggctcttgctcttccgtgcggctattcttttttatccggataattaaagtatcatggggggaatcgggagaataggaatattgggtagtggcagttgggctacggctctggccaaaatcatattgacctctcaaccatccatcaattggtttatgcgccgcgaagagcaggcgcagggcattaagcgtacggggcgcaatcctaactatctgcgcgatgccgtattcgatcctcggaaaatctcatttttcaccgattcggatctgaacagttttttcagagccagcgatgtggtggttcttgtcactccttcgcctttcatcaaatcctatctgaaacgcgttcgctcgtccagcatgcgcgacaagctgattatcaatgctatcaaggggatcgtgccggatgagaatgtcttggtatcggaatatctgcacgatttctgcgatgtccccaacgaactgataggtgtagtctccggtccttgccatgcagaggaggtggccagagagcgcagatcatatctgacggtgggctgcttcgatatcaataaggcaaaagccatggcaaacgtactacgcaacgattatgtgaagctgtacgaccagtcaggaccgtagtaggcatcgaatatgcctcggtgctgaagaatgtttatgccattgctgccggaatatgcaacggtcttgcagtatggcgacaactttcaagtctgtcttgatgtcgaatgccattgctgaaatgaatagtttcgtcaatacccgtcacctcttggaaagagagatcacggattcggtatattgggcga

SEQ ID NO: 837 - DNA (genomic), 2190 bp, PORYPHYROMONAS GINGIVALIS; double-stranded, circular
  misc_feature 1...2190
  hypothetical: NO
  anti-sense: UNKNOWN
aaacttgaaattgttcatgatgaatatgctttttgtctatagccggtaaaatgccgtttcggcctaccttttcaaaggtagcaaattcttcatcatgtgggaaaatacgatgtcgatggttggaatgtacacattccggtatcaagtacagtactctgaccaaattcttcgaataaataccttgaaaggcgtctgatatttggtttctcttagccttaaagcttactccgatttctttaatctccttaagtctcattctcataaggattttctccggatcaattcctaagtagaggtgcgcttatcgtattgtaaaaatctgaaatagaactttttatgatctgtgaaaatttccacgagggcttttattcataattcgctcagatataaaacgagagttaattcatgtagccgatttcgacgaatagtttcttccaacattcatagatatttgccggagagtaggatttgaccatcaactctgattcttgtcccattttcttacgaagagtttcatcatccatcaataagcgtaacttatccgcgaagtcttcatgtgcttccattggcacaaggaaaccattgcgaccgttttcgatcagttccctcgggccggtcggacaatcgtatgagattataggtagtgcatatgcttctgcttcgagaagtaccattggtagtccttcgaaacgggacgtcattagataaatagcagatgattcgtagtatttgcgaatttccggtgtagatggatgtatttctatttgcgactccatattgcgagatgcaatttctttacgtagcatcgattcattttcgccatctccgactatgataagcttccaatcaggcctttctcgcagcactcgtgatgcatcttctatcatgaattcaaaacccttctggtaggttaagcctgccaatcgccaacatttgtttgtgagtagtagcatctctttggactgtagtaaatgaaacttgattgggtatgacatatgctttagagcgtccacgtaagattgcctcgaacgattgctgatctctttttgtcagtgctacaacggcatcaagccctgaatacagaaacccccttatgcgttttgtaatagggcgggcaatatcataagagatatgttcgcatccgatcgtaaatattctgcctctgttactgatctgagacaaaattgtattgataaaaatattagtccctatcaataaaaccggttcacgcttcttgtatagggcttttatccttcgataagccttgaaatatactgttttgcgggctaatgcattgccataaagcctaattccgagatggtgtacttctattcctttttctacttggaaggaaggctctccttcttttgtacaaacgctgactaatgatacgcgatgaccattggcatgcaggttgttagccaagttgatcacggcgcgttctgtaccggcacggtttgttattgtatctaacagcagataaatcatagagaatattttaaacggttctttttttaagaaattcatcaaggctatttgtagtattaatagcttcaaatattattgattgtaattcctatgtgaatctatttcatttgattgatattctgggtaagcatgcggtttgttgatcgcaatatgcatattcagctgcaatattcatgattttttttgatattccaaagattctcttcagggatttgccatttgttggtcatcttattgtcttttgcagatgttttcgcccaaacctgataaaaatcattccacctcgttgttttttttatgtgcgattaaaggataatggcttttcgatacctccttcaataggcaataacacggtattctgaggtcgttttcttgcatagctctttatcggagggcataatgcaactggttgtcgattttatatgcagaattaaggtctttgagctttctttttccttgtgaatgcgacttcttcatgccttttttatctctttggcttgcaattctcctttatgttttcgcaatacccaaatacgagccaaaaaagttttcaacaacgaagacgagtttggaatgattccaaataagcacctgaatggaagcggattttgaagtcgaagaaatgagaaaacggactttttcagtttgagttttgatctaaaagagatctggaaacgatttatatataaatcatttgcaata

SEQ ID NO: 838 - DNA (genomic), 813 bp, PORYPHYROMONAS GINGIVALIS; double-stranded, circular
  misc_feature 1...813
  hypothetical: NO
  anti-sense: UNKNOWN
gccgctgctcattcgggattccagttcggctttctccttttctaattttggtagttcggcttcgagccgttccagctcctgcttctccttgaaggtcagctttcgcggacgctcggcagcgtcggttcggggcttttcgctttctgccttacgtgtcgagggggaagattcgacggtctgcctttcggcctcttcctgctgtttgtattcgcggtactgggtgtagttgccggggaaatccttcacgatgccgttcccctcgaacgtgaagagatggttcactaccttgtccatgaagaagcggtcgtgcgagacgacgagtacgcatcctttgaattcgctcaggtagttctccagcacgttcagcgtgaggatatcgaggtcgttggtgggctcgtcgagaatcaggaaattggggttcttcatcagcacggtgcagaggtagagcctgcgctgttcgccaccgctcaacttgtggatcggcgtatattgcttctcgggcgggaaaaggaactgcgtcagcaaggccgatgccgagagggtggtaccatccttttcattccgaatcacctcggcgatgtcctgcacggcttcgatgacgcgtttgttttcgtcaaactgcatgcccttctgactgtaatagccgaagcgaaccgtctcccctacatcgaaataccccgagtccggcttttcttcgccgagcagcagccggaggaaagtggtcttgcccacgccgttgggccctacgatacctaccttgtcgtaccggctgaaaatgtagtcgaagtcgctcaggatagtgcgatcgccgaa

SEQ ID NO: 839 - DNA (genomic), 3820 bp, PORYPHYROMONAS GINGIVALIS; double-stranded, circular
  misc_feature 1...3820
  hypothetical: NO
  anti-sense: UNKNOWN
ctctgggtttggtacagtgcaatgtgaagttcctcttcgaaggtgaggaagagataggctctaccaatttggaagcattctgccgcgcacacaaggagatgctatcggcagatgtgatcatcgtatccgatacgagcatggtaagcgcagaaaccccgtcgctaacgaccggtctgcgcggactggcatattgggaaatggaggtgaccggcccgaacagggatttgcactccggacacttcggaggtgccgtggccaatccgataaacgagctatgcaaacttattgccggcatcgtggacgagaacggtcgcatcacgatcccccatttctacgatgatgtagtaccgctatcggatgaagagcgtcaaatgatcgcacaggtacctttctccgaagaaaaatactgtcaggctcttgacatagacaccgtattcggggaagccggatacagcacactcgagcggaacagctgtcgcccgtcattcgacgtttgcggtatctggggtggctatacgggagaaggtgctaaaacggtattgccttcgaaggcttacgccaaagtatcgtcacgattggtggccaatcaggatcacgagaaaatatcccaaatgttcatcgactacatccggtcggtggcacctaagcatatcaaagtgaaggtgactcctctgcatggaggggaagcatacctctgccctatcgatttgccggcctataaagcagccgaagaggcgtgtaccatcgctttcggcaaacgaccgcttgccgttcgtcggggtggtagcattcctatcattgctacgttcgagaaagtattgggactgaaaaccgtgctgatgggattcggattggaaagcaatgccattcactcgccgaacgagaatatgccgctggacatcttccgtaagggaatcgaatcggtagccgagttctaccgcatatacaagtaagaagaaaccgtagagggtgcatacagggcaaaaggaaatcctgtcgcaccctctttcattaaaagaatactgcattgggcatattgataaaacaggcactgctggaaggtgtccgtcaggatatcaggatcgagggcaaccgtattgtggaggttgctccggcgattggctgtcatgccgatgaaattatagatgcctcttccatggccgttatacccgggttgcaaaactgtcacactcattcggccatgactatcttccgaggctacggcgatgatctgagactgatggattggcttgagaactggatatggccggtggaagcacagatgacagaggaagatgtctactggggttctaaattggcctgtctggagatgatcaagagcggtacgactgctttcctcgacatgtacgctcatacccttgccacagcacgagcagtagaagagatgggcttgcgtgccgtactatcatccacgctcttcgacagaggagatcaggagcgggctcgcatcgacagagaacgctgctacagtctgcacgaagcattctgctcctatagcgacaggatccaattttcggtaggacctcatgccatttataccgtaagcggagagcaattgcaattctgtcatcgcttcgcgaatgagaaaaatgtgctgatacacttgcacctatcggagacagaaggagaagtccgggactgcatcgctaagttcggtaccactcctgtcaggtatctgcacaaactgggcatactatcgccccaactaatcttggctcatagcatctggctggatgatgaggaaatggacttgctggcagctcatggctgtaaggtggtacacaatccggcgtcgaatatgaaattagcctccggctaccgcttccactatgacgagatgcgcaagcgcggaatagtcataggtcttggtaccgatggatgctcctcttccaacaatttggatatgatcatcgccatgaagctggccgcctttctcggcaaagcttggcgttcggatgctacagcagtgaaagcaaccgacatatacgaaagtgcgacagtagatggagctcgaatcatgggtacggataccggtgtcatagctccgggacgcttggcagatctgtgtctgatacgtctggacatcccggaaatgactccctgtcacaacttcatatccaacttggtttattctgccaatagcagtgcagtggatacgactattgtagatgggaagatcctgatgcgcggacgtaaagtacccggagaggaagccatattggccggcgcagctgaagctgcatacaaactgatggcaaaggcccacaaaacacacgaatgaaattataagcataccgcatatgaaactccaagaacagcattaccacgaggcagcatctttcctgtcctctcgtctaccgggcgatgccaaaacggctataatactgggtagcggcttaggcgaactggccgaaaaaatcgaaaacaagaccgtcatcccctacaatgagatacctcatttcgcccaagctacggctgtagggcacaagggtaatatcatcggaggaatcttaagcggcactcctgtcgttgccatgcaggggcgctttcattattacgaaggatattcgatggatcaggtgacgttccccatcagggttatgaagttgctgggcatagaaaatcttttcgtatcgaatgctgccggcggcatcaacacctctttcaaggtgggagacctgatgatcatttgcgatcacatcaacaacttacccaatccattgatcgggcctaatatggatatgttcggcgttcgattccccgatatgacacgagcttatgaccgagagttcatcgctaaagccaaaggcatagctcaagaactgaatatcccggtcaaagagggtgtgtatgtaggtcttacaggcccctcctacgaaacgcctgccgaatacaaattctggggacaagtgggtggcgatgccatcggtatgagtacggtaccggaagtaatcgtagctcgacatacgggtattcgtgttttcggaatgtccgtaatcacgaatgaaggctaccactttgccgatgacttcgtcaatgacgagcaggatgttatccgtgcagccaatgccgcatccgaaaagatgggcgcgatctttgctcgactgatcgctgccgtttgaaaaatgatccaagtctgaaagagacaaaaagagagcttcatcccttgctccgatgaagctctaacgataaaaacaattcgaaagacaagtcctccttgctacaaaggggggcctgttttattttctctcttatgacaaaggttccaaccgattacagggaattcttcttgaaaaggcaaaagtcgctgcaacagataagggttacgaccgataaagaccggtacaaaaaaacgagagcgaaacgtctcacgacgtctcgctctccaattaaccttaaaatctaataccatgaaaaacacaccacaaatataatcactttatgctaaacaacatattatcggggggcaaaaactgcgtgtttatgcttatttaacgttttgaaaagataatatagaacccaaaacctcctctttgggacaagataaaaaccgacttctgctattgaggccggcaaaaatagtttccccttaaactccatcaacaggctgacttcgatttagttacagctctttttctttcttggctgtctgccttatctttgaggattcttcctgcttgcgtctttagctttcttcgaatgctgtccgaaagtactctcccagtcgtttttcgttatagggagaaggccttcacgctcgaatatggttatcagagcatcgaagtttgctttgaaatcc

SEQ ID NO: 840 - DNA (genomic), 2287 bp, PORYPHYROMONAS GINGIVALIS; double-stranded, circular
  misc_feature 1...2287
  hypothetical: NO
  anti-sense: UNKNOWN
ggattcgtatctggcatcgatatcattaatggcataagatctcgtcagcagagcacccaacttttcttgcatacgggtatctgcgatttgcttttccacgctctgccattcactctggatttcgtacagatagccttgctgttcggccggctgcaatttaatttgcttgtcgctgatgtgattcagaaaatcattcacggcagccctgtcggatccattgataccaaatcgggagaaaaactgttgggcgaacatggagggctgaacaccatcaccgataatcagagccaatagctcttccggacttaccgtaagacccaacttgtcagcttgctgcccgagcacgtagtcctgtacatactgctgtgcgagctgattgttcagagaagcacgctgttcgtcggtgatctttgttccactttgctcggcgcgtttctccatcgctttgagacgctgttggtaatcgtagattttgattttctctccgttgatatccaagactacttcttggctctgacggaagaaagtagatccggatcgaaggaagtctccgataataaaggcaaaaagagccacgcccaccactacgatgagcaaaccggctttacctctgattttctctaatgtcgccattttgttattatgttttctatttattatgcactattaagaatgtgtttattaagccacaaagatacaaaccggcttcaaaatgccaagcctttcaactgattgttttttagttcgattggtcgtcgatggacattttcaccagttcgatcttggtggaagaagatctgagaatggtaaaagtataaggagcaatctccacgacctcattggcctgtgggatattttgatggctattcaggataaatccggccacggtaaggtagtcgtcagactcaggcaaggacaacccaaaacgttcgttcacatcatctatttccatacgaccactgaccagataggtatgagggccgagctgtttggctatgatcttgcgagtgtcgtgttcgtcctcaatgtcaccgaaaatctcttctaccaaatcctctaatgtgaccattccggccgtacctccaagttcatcgatgacgatcgcaatgcttttcttgcgctgcatgagtagtcgcatcagtttattggcatacatgctttcgggtacgaatacagtagtattgatacgtttttgccagtcttgcccacgaaacatttcgctcgaatggatatatcctactacgtcatctatgttctgtctgtagataatgatcttggacaaaccggtatcgataaaagtcgttttgagtacttcaatatccgtttgcaactcacatgctatcatctcattgcgtgggatcatgcagtctcgcacctgaataccggaaaaatccagcgcattctggatgattttcacttcggtagtcaagtcgttctgttcgttttctccggacatattttctgccaaataatgatcgagatctacgcgccccaaccctactgttgtaggcacataattcttgtccaccagacgaataaaagagcgagataaaccggtgaagagtttagacagaggataaagcagataatagatcgctacgatagggagggcgaataccctcatcatcatattggcattggtcttgaaaatggctttgggtagaaattccccggtaaacagtatgatgatagtggataagacagattggagaacgacgatcatagcatcgttatcaatccattgcgccaaaggtgcggccagcaatcccgccatcagcagaccatagactaccaaaacgatattattacccacaaggagagtagtcaccagttggtccggatgtcgatacagcaagtttaacgctctgcctgtgagatcgcctctattcctgtccaactcaagacgcagtttgtccgaagaaaggaaagcaatctcagcaccggaaaaaaagccggagagtaaaagtgtaatcagtatgtacaggtaattcatttttgctctttggtggttggagaaaccgatggtctcggcatgaaaggagaagcggcaggctttgctgtccgatccccttgacgaatcggtatggtgtcggcggatttgtcctcctcttcactcacatagtaagtcgccggaatgattgaatatggtgtactcacccatatcttgagttgcagtgaaaagacgtccctcggagtattttgtccnggctttgaatgtagactgtatcatcggaataaacaatggcgttcttcttatccatataaatcggggggaatggaagtctcg

SEQ ID NO: 841 - DNA (genomic), 3035 bp, PORYPHYROMONAS GINGIVALIS; double-stranded, circular
  misc_feature 1...3035
  hypothetical: NO
  anti-sense: UNKNOWN
tgccggaagtcgaacatgcggatggccagcgtacgcggatcgttctcgggttgtccctgtttggccgcccgataggtgaagagcaggccgatcagcaggacggtgagcgagaaagctcctgccaaagctgctcctttcctgattcgcgagcctatcgtccctttttccaaaaggaaagccaaggccggtttggccacgttggtcagggtgattcctcccagcagaaaggcaaaccagcgaatggtgactccgccgaaacttccacgcatcttgtaccgaaccgacagtacagtgatggaaaggggaagcaggaagaacgagagtggatagctctcgatagtgaacggcagggtaagggctgtgaagctgccggccgacaagagggtgacgagcaggctcctcgtccgtccctgacccgccacgcggcggagataggcgtaggtggccgttacgcctgctgccgtgcacaacgtcatcaaggtcagacaaatgccgagggctaagctctctcctccgattgtgacgaatccgaaccgattgaggacatagaagaggttcaggaagggatggcttatgtcgaagacacctcctgccgtttcgaagcgatagtagttgtcatagcccagatatgcaccgatgagtccgtcgtgtggtgtcaacagtccggtggatgcgatgtgcattgtcagtgctccgtatagcaggctgagtatgcagcatagaacggcttcctctcggtaccgactgagcagtcttccgatagctccctttcgtatcatttcaggcgtttcagttcttagtattgcaaatgtagatattatataatgatgagaatatactatggtctcacatgagaggatactatggtctcctatgagaggatactatggtctcacacgagaggatactatggtctcatatgagagaatactatggtctcatatgagaggatactatggtctcctatgagaggatactatggtctcctatgagaggatactatggtctcacatgagaggatactatggtctcacatgagaggatactatggtctcatatgagaggatactatactcttatgggagatcctgtttataatgtctatatttggagcctgatgagccggtcaggaggctcttcggaagttttcatggaagtaagacagaacaaatgatacagtacacagtgaaggaacgccgaatgaaagtaggcaagcatgcaggcaaaacgatgtattatgccgaggctcagaaatcgaaagtgattgactttgaagaggtgatcagggacgttgccgagatgagttcgctcacgaccggcgatgtgcgcaatgccgtggatcgactggcctattacctcaagcgcgagttgacagagggcaataccgtcaggctcggacagatcgggacttttcggctttatgcccccgggcggtttatggagcatcccgaagaggtcaatgccacgacgatcaagggcgcgaagattcagttcatacagaacaggcatctgcgcgaagcctcttctttgatcaaggtggcggtggacaatccctatctgaccaagaagaaagatctcactgccaccggcacggagtcggccgagggcgatggatcctccggtttgtagtccttggggccgattcgggtgctatttgctgctttttgcgtgtccgattatctttgcaagcataatgaagaaggaatttatcggtcggacagccaagtcgctgagtctggccctcgccattttttcaggatgtatattcggcagtgtgttgcctgcatggtcgcaggagattgtggcaggcgaactggagcgttgcttcttggccatgcccgaatccgtcctgccgatcgtaaccatggaggagcggaacgatttgtgccggagggcaggccatctctccggctttacccatacggcatctctggagtcttctctgggaggtaccgttacgtttctcctcaatcggaactttatcaggattcagaccagtaccgtcggagaggtgtttatgcgcatcctgcccttttcggatagcagctccgtcatctgcgtggtcaccaccgtcttgcaccccgtggcggatagccggatcgatttctacaccaccgaatggaagccgctcaagaccgaccgcttttggcagcaacctcggatagaggattttttcctcccccatacggacaggcagtcgtatgcctatcaggccatatatgcaagtctgacgccgtcttatatgcaggtgtcgctctcggaagagtcggatacactctccatccgccaaaccgtgacagagaccttggcagaggaggagaaaccgcttgcggcaatttttctttcacccgaaccgttggtctatcgttggcagtccggacgattcgttcggcaggttcgataaagcaatacatattattaaggtaatagcaaggaaacgatggaagtatcgaagaagaggctcgtcctgatgggggttgccgtactcgttcttattgtattcataggggttttcttcaattggcgtgtggttcgcgaacgtgctgctctggaacaggatcgcgagaactttgccaagctcgaaaaggaggccatgcaggatgaactggatcgtatatccgaggactatacgcagcagtacaacaagctctccggctctacgggagaaatgaatatccaattggccaacgattcccttctggcacaactctccgccgagcgtgcccgcgtcaatcgattgcaggacgaattgaaaacagtcaagacgaccaatgcacgcaggataaacgagctgagaggagaggtcaagacccttcgtgccatactgaagtcgtatgtcgtgcagatcgactccctcaatgcagccaatgcccgtctccgaacggagaatcaggaggtgaagcgcaacctctccgaggccgtgggcgaagccagtcgtctgaaagtggagaaagccgaactgaccggaaaggtggagctggcatcgaaactggaggctaccggcatatcggtggctttgctcgacaagaaaggcc

SEQ ID NO: 842 - DNA (genomic), 576 bp, PORYPHYROMONAS GINGIVALIS; double-stranded, circular
  misc_feature 1...576
  hypothetical: NO
  anti-sense: UNKNOWN
gcctccgaagttcaaggtgcctaccggcggttctaccctgatcaagtactggctatggtatcattccgaagctatgtatgtgaataagttctatatcatgatatatgactattccaaagacgcttgggagcaggggtatttattggccaatgagttcaactcacctcttcactacgtggaagaatacactttcgatttgtctcaatggaaggggaaagacatcaaggtggctttcgtgaaaaacggtacctatcaaatggctatggatgacatcagaatcctgaactaccaaagcctgcaagaggtagaacaagaaggtattcggatttatcccaatccgactacggataggctgatgctggacaatgtgggtgatgtaagcgccattcgtattatagatatgtatggcaggccgcttgtggtggtcggcaatgccggtagctctaagttgagtatcgatgtctccgatttgggacggggcaattatgtcgtcgatatgcagtgcaaaggccataggaaaatcagccggctgataacaaaagagtaaatcgccattctctcccgagggggagggcc

SEQ ID NO: 843 - DNA (genomic), 2853 bp, PORYPHYROMONAS GINGIVALIS; double-stranded, circular
  misc_feature 1...2853
  hypothetical: NO
  anti-sense: UNKNOWN
cggctataatctcgaagcaaatcctctctgcaagctgcaagcatgaaatttcgacaaacgaaattccacactgcaagcctgcaatatgaaatttcggcgaaaaaattactcgctgcaagcttgcggccattaatctcggaagcaaaatttgtcactgcaagcatgtaacagtattttctgcaaccgaaatcaccgtctgcaaacttgaatcaaagagatactaatcataagacaattattttctcaataaaataatcattacttccatatttagtcatagctatcatgcgtacttatttcaaattcctcagccgcaacaaactctacaccttcgttaccatcgtaggctttgccctctcgctcatattcgtcttgctgcttagcttctatgtacggcgcgaacagcaagccgatcgtattcataccgattacaaacgtatctatcagtacaatgtcgagagtaagaataactggagcggatttatctgttgctatcctgccggaacgctcattcgcgagcaggtacccgatgtggaagagatatgccgcatcagcgaatacaacgacaaggaatacatctttatcggtgccgacaagcaaaacgggttgattgcctcccatctttcggtcgaatccaacttctttactttcttcgacggctataaactccttgagggtgatcccaaaactgtcctttccgagcagaacagtgccgttatttcctccgcgttggcagcccgtatcttcggtaacgtgtctcccatcgggcaggagatttcgtttttcgatttttccaaaaacaagcagacctttcggatcacgggcatcatggagccgatgccggataactgccatatcagaccggccgaactccttttctatcaggagcccaaagaaaacaactacaacaacggcaactatgccctctatctcaaagcccgcgaaggagccgacctcacggcacaactacctgccgtgcagaaagccgtccaaggcaaagatgtcatattcgctttcgacgagaaggccgaggtgaagctccatccgctggagaaatgctatccggagccgctattccccaatgaatacgccatgatggtgcaaaaaggaaatcccgcccgcacgcgcatactcattgccatcacccttttggtcctgatcattgccatcatcagctatatcaatctgaccctcgcgcagggaggcagccgcggcaatgaggtcgccctcagaaggctctggggaagtagccgtctcgccatcgtgcgccgcctctggttcgaatcgcttctgctcatcttcctgagcacgctgctggccgtattcggcatgttcgcccttgaacccgtattcgatcgcctgttcgatacgcatctctatctggcacggcatatttcgctcacgctcatcctactgctaatcggcttcatgctcctgctgagcatcgtgtgtgcggccctgcccgcatggttcatatcgcggtttcgtccgatcgaggtggtcagcggcaagtttcgccgtgtggtcaaaagcagcttctcgcagattatggtcatttcccagtatgccattacgatgatcctgctgagctgtaccatggtaatggccgtgcagatcgactatatgaccaactccgacatgggctacgattacaggaacaaactgatcatagacgttttcggactggatccgcagatcgtcagtacgatgagaaccgaaatagccaaaatccccggcataacgggtataggcctcacgcgtggtactccgctgaacggaggcaacaacaactcttccgaataccgtggcaggcctctctccatgcagattttctccatagactccgtggcactgagcctgttcgatctgaagatgaagcccaacggtcgcaaggccgacaagcccgatcgcaccctctatctcagccgatcggcctacaacgatttcgatgtagccaatctgccggacggtgtcattcattggggcaaagccggtgagttctattattgcggcgatgctcccgaggttcacttcggcggattcaaggagccgcatccgagctatctcttcatcccttatccccagtcatccgcctggtcgtggtccgtactggtcggctattcggaaggggccgatccggagcagttgattcaaagcatacaggccgtttactcccgtattacggggcagccctataccgaaatcctgcgttcggaagacatcatagcctcgcacagcgaggaggaacgttcacttagcggttttcttctcctcttcagcattctggcattggtcggaacggtaatgagcgtctttgccatggcagctctgcgcattcgtcacaagcaaaaagaaatagccatccgcaaggtggtgggagcacgcgaagtgcagatattgcagattatcggccgccgcagcctgtggaatctgctcaacgccttcgccgtggccactcccgtctcctatctggtcatgaaccgctggctgcaaggctatacctatcatgccgatatgccttggtgggtattccccgcatcgcttctcttcgtctccgcagtagccatgctctccatgctcagcatggccatgaacgctgcatcgagcaaccccgtcgactacctcaaaaacgaataacaaaaacagcatcaaaaacgattgtcgtcactatgcgtacttatttcaaattcctcagcagaaacaaactctacaccttcgttaccgtattcggtttctccgtatctctgatgtttgtcatcatattaggcatatacatccggaacgaaatgtccgtggatcgcttccactcgaagtccgaccgcatcatatatgctctgctcggagcaaggtgcc

SEQ ID NO: 844 - DNA (genomic), 1240 bp, PORYPHYROMONAS GINGIVALIS; double-stranded, circular
  misc_feature 1...1240
  hypothetical: NO
  anti-sense: UNKNOWN
acctgtatctgtatatcctgattttagttgtttttagtcattcaatctctacgtagccaattttatcggataacataattcccttttttcttcctgttttttgtatcattcttcaagcctctaaaatataatcatagcagataatgaggttctcctgcatatgtattgaaaaatcataacaaattgcaatgatgttaaatattttccattgaacgcaacggcttatactttagtctcattttagatatatagagacgtagattataaaaaccattgcatcctacgcaaaattctttacggaaagcgaaaaaagatgtgtaataaaagtaatggaagctgccggggtgcaactaactttacattgttatgcagaacgtaggattaagactcaaacaggagcggaacagaaaaggctattccttacagtatgttgctgcttcactgaatgttagtaccactacagtctatcggatcgaagccggaaataaatatttaagtatggagcttttcgaccggtactgtgaacttttggaactgaatcccagagacgtgttttcgaatcctgcaatggaagaacgagaccggattgctcttgagatcggccgaaggtttatagagataatggagttgggggtaacaattatcctgcccaagattatgaatatcaatatccgacccgggcctccggacagtaaaatgaaacaatagatatgatggaaagcgatgaaataaaaagcattcaagaaaacctcaaagatattcagggggtgttatcggagatacatggttttatgagagacctgaaaaaagattacagcccggtggatgaaagcatcagtctggattcgagtatgctcgccatgcttttgaatgtctctcctactactgtttaccgatggagagcaaggaatgagttgccctacacgattctgagcagcggagcatgtgcctatcgattcgacgaagtgtacgtggccgtcaaatgtggccggttaagagcccgcggattcaatcggatagaggcattaaggactttatccgtctatcgggacggtatcatagagggtggtggttttgaagcaaaggaaaaagaccctngattcatatcaaggaacaaatactgggaaagaacggatgaagggttgncttgtattcaactactatatgccttttcctttcaagcccgaagaagaaatttcaaaacccgctctacgaagacaaacgagctttcctggtatat

SEQ ID NO: 845 - DNA (genomic), 1666 bp, PORYPHYROMONAS GINGIVALIS; double-stranded, circular
  misc_feature 1...1666
  hypothetical: NO
  anti-sense: UNKNOWN
cattgcggcacctatcagcagcaagccgatacctgtataaacgccatagagccaatcgtctttgaccagctccaactccgacatcgtactccatcgcccttgttcgcgattgtagctaagctgatagatataccaccctctgtaacggagcggtttattgaccagtatagtcgcgctgtcgatctcgccattctcagcgtataggtatacctgcgagctgtattgtttcggatcgggttctgccatcacgagcgacagactgtccgttaatcgtaagcttcgatagggaaatacatggctacccgatgacacccaaccggataccacttcttggggaaaatctaaattcgcagctcttactctggctgaatgtacggctcccaatgacctgaattcgcggaagacaacggagtctttggtcacgacagcagccgaataaggcagatgcgccaatacctcgatctgccagcggtctatcgttcccttggaaggagtccgatctatggacagatgcgccggacgagaatagggaagagccttgccactattgttgcgtatgatcatcaatttgggagggtactctgctatttcgaacttttttagttctatggctacggggagttccaccatttttttgtccgttggtctatgcccctccactcaggatagtcggagtcggaatatacttgcattctgtattgccggatgtcggcagaagacataagcccgaaaaaaagtgcgacgaacaagcccacgtgattcatcacgaaagcaccgtcacgaaggttcagtttcagacgcataagcctgtctgtagtaacgcagcccagtacaaagagcaaatacagatacagcagcaggaagtaccatgccgatagcatggagctaagtcccaaacgatgaataggatgctgcaatcctctccccatttctgcggggatttgtttggtcagccccatgatgactgcaagcagcagtagcccaccgatagaagtcagagtggctatgtggccagatagaaaggagaaacgggccgaattgcggcgtatagctctacgatggaatatgccccaaaacaagatgccggcaagaagcaaacttcctccgaccagattgaaaggatacagcgaaagctgtggccagtatcgggcctgcgatcacctggagcaacaaacctacaaaagcaagtcctgatatgatgaatatgccttccctatagccgaagcgtccctgccacatagtgttgtatgccgaaaaaatagtaaacagtcttagtgaaaagaacagatcagtcttatcgtattagaccttatttggctgctatcaaaagaccttttccttttgctttcttcacccacttgggcaccactgtctccaagaacttttctttgttcttgtgcaacccatccatatccaagcctatatacttctgggctttttctttggtggagacatcaggcagtggtacctcatccgtatagccatgacgtgcaagtacccgagctatctctatacgtgcttgcatcgcacgctccagcccgttgctgagaatacgtgtaatctcttgcggtgcatggaatgaagctccatgagaagccactccatagtcccaacgccactgtgattggcggatatacttaagtatgggggtcattttccttttctg

SEQ ID NO: 846 - DNA (genomic), 4672 bp, PORYPHYROMONAS GINGIVALIS; double-stranded, circular
  misc_feature 1...4672
  hypothetical: NO
  anti-sense: UNKNOWN
ggcttgcccagccggaattgcgctattggttctgtgagaaattcaatggagtgtttatcggacttcatggccatgtcggtcaaatgaatatcgcagggatatcggtccctcctgttggttccattcatcctaagagcgacttcgacgatgccaggtatcatcgttatcaaggatggttctatggcggcggtatcagtataggccgtcagtggatcttgggcaatcattggaatctggaagcgagtatcggtggtggttatattcacttcgattatgacaagtatcagtgtgtagagtgtgggaagaaagttggtgttgacaagaaggccgattactttggcctgacgcgagccactctttcgttaatctatctgtttaagtaattcctaattaataaatgaactctcaaaagaaagaggcttttaatatgaaaagaatacaactaactcttatcgctctcttcgccgctgttgccggtttggtcgctcaaaatgcttacgagggagtaatttcatataaaatttcgttggacaaaaccggaaacaaggttgtactgaatggtgcggcagatatgagtaatttaaagctcaagagcactcagatgatcattgttacgcctattcttcgttcagaagatggtaccagccgggtggaatttccttcggtagtcattacaggccgcaatagaacaaaagctctcaagcgtgaaatcgcatttagttcggctttgccccaagcaaaacatgcagctcaatacattcgccgtcataatgggaagagcgagcagtttgcttttacaggagaacatgcttatgcatcatggatgatggatgccaagtttgtggttcgtgaggaggtacgaggttgtgctaaatgccctgtaggtctctcgagtaatattgttccttttgatccactcttcaatccggcagaggctccttatttgttggcacacattactccggcagaagaagtggaaaaacagcgagagtccagcttcgatgcttatatcaacttcaaagtcaataaggcagatgtccttcctgagtatcgcaacaataaggcggagttagagaaaatcaaagaatttgtaagcaccgttaaggctaatccaaactattcggtcaataaaatgatcatcgaagggtttgcttctcccgaggcttcaatagcccacaataaggctttgtcggagcgccgtgctaaaagactcgcggaagaattggtgcgtaagtatggcaaaacattgccgaatataaccactgaattcggcggtgaagattggaaggggctgaaactggctatcgaaaagagtgatatagccgatcgtgaccgcgtattggagataatcaactccgataaatatgccgatgatgatgcacgtgaacaggctctgaagcaactttcgtcttatcgttatatcttggatcagatctatccgaatttgcgtcgcaatacgataaccatggggtatatcgttcgtgattataccctcgaagaagctcgtgaaatcattaagactgctccgaaagaacttagtgaggccgaaatgtaccgtgtggcaatgtcttatcctgaggggcaccaagagcgtttgtttgctctgaatacgacccttaagtatttccctgaaagtgtaacgggccgaatcaatttggctgtagccgcttttaatggtggagacgttcaacaggcaattgctctgttgagtccgattcagacagaaaagggtgtaagcaatatccttggagctgcttatgctcgtacgggagattttgctcgtgccgaaaccttcttccgtaaggccgttgcagaaggagatgcaaatgcgcagcgcaacctcgatatgctgcttggcaaaaagtaagtggagttttccatattgattattaaggtgcaccgggacttctgtttcggtgctcttttttgtggcaaatcaagtccgcatgcatcaatgtttttatgtgccaaaagttttcaacgacgaggaggaatttggaatcattccagataatcccctttatgaaaaccgaattcaaggagaaaatgatagtgtgatgatttttcggataggaaggcctttttcgtcaggtcgaacaacaatacgaccaaactgaaccatagacccagaaaaaactaaactttagaactcctttcgagtgcttcttgctaaatttatcttagtgttgcatttgtttgtgggatgtgtacctcaaatcgtttaggagactattgaagaaaaaggattattttcgcgaggtaaaatgtaggaatacaataagattcacacatcaagatagcatggcacaacaggaagatctcttcaaaaaaatagtctcacactgcaaagaatacggcttcgtctttccttcgtccgagatatacgacggtctggcagctgtgtacgactatgcacaatacggttctgaactgaagaacaatatcaaacgctactggtgggaaagtatgaccctgctgcatgataatgtggtgggcatcgactctgccatcttcatgcatccttcgatctggaaagcttcgggacacgtggatgcgttcaatgatccgctcatagacaacaaggattccaaaaagcgttatcgtgcggatgtactcgtggaggatcatctggccaaaatagatgaaaaaatagcaaaagaagtcgccaaagcagccaaacgcttcggcgaggcattcgacgaggctcaattccgagccaccaacgcccgtgtgatcgaatatcaacagaagcgagatcagatacacgaacgctttgctactgcactgaatgacaacaatctggaggaaatccgtcagattatcctcgactgcgagatcgtctgtccgatcagcggtacgcgtaactggacagaggtgcgccagttcaacctgatgtttgccacggagatgggctctacggccgacggtgccatgaaggtatatcttcgtcccgaaacggctcaaggcatatttgtcaatttcctgaatgtgcagaagacgggacgaatgaagatccctttcggaatttgccagatcggcaaggctttccggaacgagatcgtagcccgtcagttcatcttccggatgcgcgaattcgaacaaatggagatgcagttcttcgtacgaccgggtgaagagctgcaatggttcgagaagtggaaaaacctccgtatgcagtggcaccgcgccctcggcttcggagacgacaaataccgtttccatgatcatgacaagctggcacactatgccaatgctgccaccgatattgagttcgagatgccgttcggcttcaaagaagtggaaggcatccatagtcggactgacttcgatctctctcgccacgaagagtttagcggcaagaaactgcagtatttcgatcccgaacagaacaagagctacgtgccgtatgtagtggaaacctccatcggactggatcggatgttcctgacgattctcttcggatcgtattgcgaagaagagacttccaacggcgagatgcgcgtagtgctgaagctgcccgcagcattggctcccgtgaagctggccgtactccctctggttcggaaggatggtcttgatgcgaaggctcgggagattgttcacgacctccgtttcgacttcgcctgccaatacgatgaaaaggattctatcggcaaacgctaccgccgtcaggatgcaatcggtacccctttctgtatcacggtagatcaccaatcgctcgaagacaataccgtgaccatccgctatcgtgacacgatggagcaggagcgtgtggagatcagccgtttgaatgctattatctcggaatatgtaagcctcaagagcttgctcaaaaagatagacctatgaaaacgaaaaagaatatcatcatggcccttgggctgatgctggtaaacatcttccttgttttctcctcgtgcgagaaaagaccgaatgaggaaaaacagcgtcgtcacgacaacgaagtggccttcaacgcctatgcggacagcaccaacttcaagaaagtatctgttgatggatcgaccgcatacgtttacatgcgctggataacaaacggtacgggtacagagcatccgatcgccacctcccgtgtggaggtccactaccaaacgtatcgtttagtaagaaatatcatggtagatggaaactataactccgaaaagccggcacgtatcacactttacaggaatgagaaggataagtcgatcaccggcttccgtattgctttgcagaatatggttatcggagacgagtgtgagttcatcgtcccctggtatttagcctatggaagcaaaggcgtccctgcatcgagcgcaaatctcgtacccatcccctcctattccgcactacgttttatcgtaaaactaagtggcattattcctgaagaagacaagaaatgaaagccgatccgattgaaattttagtttcgaatgacgatggttttcgagcacagggtatccgcgagctggcagaagccctgcgcccattagggaatgtcacgatcgtagctcccgacgggccacgatccggggcttcggctgccattacctctactctccccatcaagctcaagcttcggcacagagaggaaggctatacggtatacagctgtacggggacgccggtagattgtgtgaagttggcgatgaacacagtcttcaaggagcgg

SEQ ID NO: 847 - DNA (genomic), 1420 bp, PORYPHYROMONAS GINGIVALIS; double-stranded, circular
  misc_feature 1...1420
  hypothetical: NO
  anti-sense: UNKNOWN
ccacagaccaaatggggattgtagccgaactggtattgccataacgctcgatattgaccatcactttctcatatgggactcccatacgtcgggcaacggcatcgatgattcggaggttggcctgatgaggtactacccaagtaatatcatcgtgcgaaagattgttgcgctccatgatctccacacagctgttgcacatatctacgacagcatgtttgaagactacctgcccttcctgatacacataatgccaacgattatccaccgtttcgtgcgtagcaggacatgccgatccaccggccttcatgatcaaatgatctttgccgatgccattggagtgcagcacagcatccataacgcctacttcttcttcggtagcctcgagcaaaacacaaccggcgccatccccgaatagcggacaagtggctcgatcggtataatccgtaaaagctgtcatcttctccgtagcgatcacaaggatcttggaataacgccccgaacggataaaattggctcccacttcaagggcataaataaacgtgggacaggctgcctgcatatcgaaagaaaagatgtcgccacaaccgatttcatgagcaacgatgctggccgtggaagggaaatgatagtcgctcgagttggttgcaaggatcaagccgtcgatactcttgggatcgataccatgacgttcgaagaggtcttgtgccgcacggatggccaaataggaagctcctttattcttgtctcgaaggatccgacgctctttgatccccacacgggtcatgatccattcgtcattggtatcaaccattttttccagatcgtcattggtaataacatcttcagggagataggccccaacggctgttatagccgcgtttattttattcataatcgaatttgttgcataatggacgggcaccggccctttttaaagaccatatcccgccggaaaagattatttgtggccgctaaaataaaaaaaaagtcccaaagaacaggtctaagggactcttttgctcgttcttgccgcctaagcgacgaccggcatcgaccgagggcaagcaatttttacactgccacttctttttcgattgccaacttaccgcggtagtagccacaatcaccacatactgtgtgatagatgtgccatgctccacaattaggacacttggccaaagtcggcataacggctttgtcatgagttctccgcttggcggttctcgttttggactgtcttcttttaggatgtgccatttttatttatttaaattgttctttttgttccaatagttttccaagagaatcccacctcgaatcgtgagcggtcataccggattcttctgttgcttcatcggcatctatcgccagcagatcggacattcgattcatcatctcggggtcgcactctccatccgaa

SEQ ID NO: 848 - DNA (genomic), 738 bp, PORYPHYROMONAS GINGIVALIS; double-stranded, circular
  misc_feature 1...738
  hypothetical: NO
  anti-sense: UNKNOWN
gacgatgctccttgctgataatcgtagccataaggttaccgccgaaagccggacgtgtcatcagcagattgcgttcgtcaccgatctcaagcgatgtacagtctgctgtaagacctgtacgcaagcgagaagagagacggggaccgaggtcgcgaccaatagtcgtagcaccgaagagtacgatctcaggcttcttgtcctgaagaatttgggtaatggcctgagcgtaaggctcagtaaggtagttctcgagcttctcatcgtctacgacaagcaccgtatcggcaccggcagcgataagttccttaggcaagtcagcaaccttatagccacaaagaattgccgttactttttctccgatggtgtctgccaattcacgagcctttccgatgagttcgaaggctacgttctgaatcactccttcgcgttgttctgcgaagacgaaaacacctttatataattccttatccatagttgcttgttgttcagatgatgaatttctctttcagtttattgaagataatgtcagcagcttcttcgggagtgatatcttcatgcagtgctcccatggccttggctcccttagtgaacgacttcttgacgctcgtgggagaaccggccaaaccgattctttccggatcaacatcaatgtcgcttgctccccagcactcaataggtctgtcgaaggtttccataatgccacgaacgcgcatgtagcgaggcttattagccgtagcc

SEQ ID NO: 849 - DNA (genomic), 3115 bp, PORYPHYROMONAS GINGIVALIS; double-stranded, circular
  misc_feature 1...3115
  hypothetical: NO
  anti-sense: UNKNOWN
agccactcactaatgatacgggttttatcatactcgaaaccatatctgtattttacaccgtctttcaaaaattgtatttcaaaagaagttggtttttgggcagattcccgatccaacataaacgggtcgaaacgaagagtatcctgagggttcaattttaccgaatccaatacgatgctacgcattttggccaaagcaaaaagagcattgctttttccacttgaattggctccgtataaaacggctgccggaaggagtttgtaagctcctttcctaatgacagatttggaaagttctttgatggcagaagcttccatgctcaaagttttttcatctctgaatgagcggaaattcttaaaagtgaagttgaccaacataactcacacaataattatttgagggcaaagttatctaacaagcccggaaaagcaagaaaaacgagaaaaaatctcacaaatagcggccttgcgttctttgcagggagcaaaagatacaccataagaaagattgtagacaaaagaagaacaacaaatctcgagccggaaatcgccggaaagtcgcgccgcaatcttgaaaaagtcgcgccaaaattttttcgttttggttcgggttttgaaaaaatctcgcgcgagagcggaaattttttcgcgccacgtttttaggaatagcaaacaataattttcacggacgagaatgcagagcgaggagagatggctgcaatgcttttgtattgttcgtcaaggagtaaaaccgcgcaagaggttttgttccttcttcctgtggcgcgtcggagcggaggagaccgcgagggggcttttggcagagggagaagtatcggtcgaaaacagtatttttgtggccaaagcacctatatttcttagggttatgagaaagaaccgtttcggccgattgcagcttgccgtcgtggcagctgtcattataggcttgtggatgctctcggcatgtgccaatatgggtacgccggagggggggccttatgatgtgacgcccccgcgtttgctcaaggctacgccggcaatgggtagcacgaagcaaacaggcaataagatctccctcctattcgatgaagctatccagatattgaaacaaaacgagacggtgatcgtctcgccaccacagatcaaacagccgaaaatatccgtctatggccgcatgctgaccatcgagctgcgcgacaatcttcgcgacagtaccacctatacgatcgactttaccaacggtttggccgacaacaacgaagggaatatcctggaaaacttctgctatgctttttccaccggcgatgtacttgattcgatgcagatcggcggccgggtgatcgatgccctgacgttggagccggtggcaggtgtcttggtcggcattcacgattcggaagcggatacggctttcacgaagactcctttcctgcgtactacactgacgggagaggacggctccttcacgttgaaaaatctccacgacggccgctacaaagtctttgcccttcaggacgccgatcgcgactacgcctatagccagttgtccgaaggcgttgctttttctccggattggtaccgtaccgaggtggcagatgatgccttgccttcggatacactcttggccaatgccgatacccttatgccggtggattcggcaatggcggaaaaagggaaaacatccactctccaggaaacaccggccgaatcggcggcagcgaatacatcgcttcggcaacagcctgtccggtatcgccccgacaacgttctgctccgattctacacctccgacttccggcgggaatatctatccaagaaaagtcgtcccgattccgtacaagtgtctctactattcaacacaagacctgataccattccggcactgcacctgctgggagagcaaaagggaaaaaactggtattcggctatcagaaaaggtgagaaagagatcgtctactggctgacggataaagagatctatagccgagacactttggccttttcggtcacttaccccaaaagcgactcgctcaacattccacggccacagacggacaccttgcggatggccaagccgaaagtatccgtacagcgccgtccgaaaggcgaagcagcagcctctgctcctcttatgaatatatccatcaagaatagtagcagcatagcatcgggtactccgggcgataccatcagtatcatagcatcccaaccgttggctctcgtggatacggcaggcgtttccgtagcacggcaagcggatagcttgtggcgcgatgtcccgttcaagctccgtcccgattcgctcaatccgctgaagttcttcgtcgatgccggctggcagatggggcagagctaccgcgtacggatcgactcggccgtctggcgaagcgtgtacgaccggtggaacgcccccgtggagcaggtgttttcgttccttccggaggaggatctcagcagcctgttactgaagttgtcgggagaggctgacagtactgccgtagtggaactgctgaataagggtggagagcccgtagcgacaaagaaagcagaacggggagaagtcctcttcccgtacctcaagcccgatgtctactatgcacgcctgtttctcgatgagaatggcaacggtcgctgggatgccggcaattacccaacaaagcagcccgaatgggtgttctactaccgccaatcgtttaccctcaggaagaactggcagcaggccgaagactgggtagtcactcgtgagcagtatgccgatcagaaaccggaagctatccgaaaggtaaaacccgcagagaagcaaaagcgcgacctcaacagggaatacgaggagcgaatggctcgcagatcgaagaaaaagagtaagaagtaacaaagcatcatatccccctgcacaatcatcgaccgatgtagaggagaagaatcaccacataatgaagcaaagattttcgactatcggcataccgctcatattcgttttgggagtattgctgtcgggttgttacggattcgatccgatcaaggataaacaaaacaagctgaaggaagaactcaataacggaggcagcgagacttcgccgactcctccggagggacagtcggtattcgatgtccgg

SEQ ID NO: 850 - DNA (genomic), 2870 bp, PORYPHYROMONAS GINGIVALIS; double-stranded, circular
  misc_feature 1...2870
  hypothetical: NO
  anti-sense: UNKNOWN
atatattccttgctcaggagggtgccgcaaagctcccggaagactttgaacccacaaccatccgttacgcatttgacgattttgggaaacacccgtaccgaatcgttcccgcatagcgggcagcggtaagttttgtaatgagcatccgtgtttccggcggctgtcgtcagcagttcttcgcatatttgacgggtataaacttcgatgctcttcccgaatgtccgttcgtccatggcgcctgcttcaatggcagccagagcgacttcccatgctcccgtcatttcggcgtcggcgatctttcgtccggcgaccagtttatagacggaaagacctttttcggtcgggataagcatcttcttctcccggcggatatattctcgcaggatcaatgtctcgatgatggccgcacgtgtggcaggcgtaccgatgccgcaaccggcgagggctttgcgggcttcttcgtccgcaacttcccgtccggcgtgctccatggccgacagcaacatggcttccgtataaaggggcttgggctttgtttgatgttcggtcatttcgaatccgaaaacatcgagccggtcgccttcctgccattcgggaaagctgtccacaacggtttctccttcttctacaggctcttccatcgatccgcggatggctttccagcccgacttaacccgtctcttcgcctttatcccgaaacgatgctccctttgagagagtatcgccgtcagcgtttcttcgatggccgcttcggaaaaggattccagcatacgcacggtgaccattcggtagagcacctcttcgtcgcgggtcaggctgtcggacttttctccggtaaggagaatggcatggtggtcggttactttcgtatcgtccacgctccggcggttaagtgtaccggcagtgagcttttcgacgtaatcgccataatcgggatcatctttcagactttctaatagcgaagggatctcttcaaagatgtcttcgctgatataccggctgcctgtacggggataggtggtacactttttctcgtacaggctttgggccagagagagcgtcttttccgccgtatatccgtatcgcttgttggcttctttctgaagggcagtcagatcgtagagtaaaggtggtggcacaggattcgtttgtacggaaacggacgaaacgatgagtgcttcgcgcggatccagatctttcatcgccctgtccgctgctctgcggctttcgtatgtcgtttctccgatggccttgacggagaggccggtgggcagcgcatggattttccaaaacggtacggaccggaaatcccggtgctcgatatagcggcggcaaatcatcgacagagtcggtgtctgtactcttcccagggaataagcgcctccgcgagcgatggagagggcgcggctggcattgataccgacaagccagtcggcttcactgcgagccttgcccgagagataaaggcggtcgtactgccggccgtcagccggacgggacagtccctcacggatagccttatcggtgagggagctgatccacaggcggtcgaaaggtttgcggcaatccaaataagcatagatcaggcggaagatcaactcgccttcgcgtccggcgtcggtggcgacgatgatgtgatcgcttcggtcgaaacacttgcggatgatattgagttgcttcaaggcggacgggtcgtccgtataggtcgttcctttgcggatctgtcggacgactaaccggaaaggttcggggataatgggcagttgctcgcggctgtacgtcggaaagccgtatgcttcgggcatcgcaagggtaacgaggtgtccgaaggcccaggtaaccacatggccgtttccggagaaacagccctcttctttgtgcgttgcaccgacgatgcgggctatgtcgcgggcgaccgagggtttctcggcaatgatacatttcatgggagacgatggttaaggttgagataaaataaccggccgaacggtggcgtcccatccgtccggcggttcatgagagcggagaaaagggctacatcctgcgccctcttttgcgaggctgcttctgctcttcgttctcctgttttgcctgttgtttttcggtagggcggtacctgaccggcttttgaggggctcccttgacgcgcccggtagcttcgttcgtcttaccttcattgttgacgggctacctgcgtcttgtgcccttcggccacggctttgacctgttcctgcttttggtccggattatagcgataaaaacggggacgctgctgctccttgtcgtaacggacataggcactgaagatttcgccttccttatccaccatatttttcagatacagggtgcgtccttccgaaagggctttctgctgtctctcggtcagctgatacttgcagagggttgccggcacgccatacggagaatctgcctgcggcttttgagagagttgcctgcgttctttgaaggaaaggttgtcgttgaagataaactcgatgcctcttttctcggcattgacctgaagcgtggcatcgaacggtttgccgccacgcgagagcataccttctacttttcacgggcttaccttcggtcaggtcccgatgctgctgttcggtcagcaagacgcttttaatctcttgcggaatgatcacgcggtcggcacgaagggcgaccagctcataggtcaacgggtcgattgagacgtagcctttgaagggttcgccgtttttgggggtcagctccacctgtttccccagattgcccgaatgcagcagcgtcgctttttcgtcctcgctgaaacgatagcccatatagggaaaatcgagccgcggctctttgcggatgctgtggatggccagccccagactgcc

SEQ ID NO: 851 - DNA (genomic), 768 bp, PORYPHYROMONAS GINGIVALIS; double-stranded, circular
  misc_feature 1...768
  hypothetical: NO
  anti-sense: UNKNOWN
tctttgggcggatacttgaatttgaaattcctcggactcttgaactgcatgatgtagtcagccttcaagtcgccatattcgggatccgtcagatctcccagcagcgtatagttcgttcggttgtaaatatcgcccatcggtatcgtcttgacagaaaattcgagcgtatccactctggccgaaaccggatccgaaggaggctggatagaacctccgatcggagacagatcatcatcgcaggctaccgtgaggagagccattaacgaaaaaacaagaagaaggtatctcttcataataatggtgaatcgttgggtttgcgtggaaaggcagataattaacgctaatcgctgcctgcatattgttttttacggcgcagtcgggcagaatgagacaaatcagttggccgtcaaaagatcgctatagaagttatcgaaagcttcttcatagtcctctttcccttggtatgggaggaaagccttcccctccaaagaggatatatagtcggtcagctccggtgctatggtctccgatccctgaatgacaccgtcggcatatcggatggccagacggttcaaggccaaatagtcggacgactgctccattacggacaggtcatcgggcgtgatcttgtcgaatccgagcttaccgaagagggtctccgggatcactccctgtccggcatcatcgtagacggagtagaccacttttgctttttgcaggcaaggatcgtccgcatacatcttcttcagatacaggcagccaacgccg

SEQ ID NO: 852 - DNA (genomic), 3050 bp, PORYPHYROMONAS GINGIVALIS; double-stranded, circular
  misc_feature 1...3050
  hypothetical: NO
  anti-sense: UNKNOWN
gatgcggctcacgggacgtatctctccggagagtccgacttcgcccgtcatgcatacggccggcgggataacgatgtccagactcgacgccagcactgccgagataacggccagatccgtagccggatcggctattttgatacctccggcaatgttcagaaacacatccttctgtatgagcttgaagccggcacgtttctccagtacggctaagagcatgttcatccgccgaatatcgaagcccgtggccgaacgctgcggattggcataaatggccgagctgaccaaagcctgcgcttcgatgagtatcgggcgaatgccctccatcgctacggctatggctatgccactgaggtcttccctattgcgtgtgatgagatgttcgctcggattctccacgccacgcagaccgtcctgccgcatctcgtatatccccagctcggaagtactgccatagcggttcttctgtcctcggagtatccggtagagatgatgcttatccccgtcgaagagaagcaccgtatccactatatgctccagcaccttcggtccggctatgctaccttctttggtgatgtgtccgatgacgatgacggggatacccgtagtcttgcagtatttgagcagtaaggcggcacattcgcggatctgccccacgctgccggccgagctttccatttcctcggtatagaccgtctgtatagagtctatcacgaggagatcgggtgtgagttcttctgcacgggagagtatcctctctatattcgtttcgcagtatacgtagcacccattcatggcttgccccagtcgttcggcgcgcatcttcagttgtcgggcactttcttcgcccgacacatagagcgtgcgcaactgcggcagacgcagcaccgtctggaggataagcgtggacttaccgattcccggctcgccgccaagcaggacaaatgctcctttgacaattcctccacccagtacgcggtcgaactcttcatcgccgaggcgaatacgctcttcatcgccggactccacatcctgtaagagtcttggccggttgtcctgctcccgaggcataaaactcttggctgcatgcttgcccgatgccggtgccggcaccttctcctcatcaatgcagttccactctccacaggcattgcagttgccttgccatttggcgtatttggttccgcacgaacggcagacgtagatcgttttctccttagccatgcttcagttgttgtcgtagggtgctgtatgggagtaggggaggatttattcgcgaaccaacggcatcgtggagcagcggagcagtccaccctgcttggagatctcggcgtagggtacttcctctacggtcatcccccatgcctcacgcaggtggttgttcaggcgtacgaagttctgttcgcttatcaccgtgtcgggactgatagagaatatattggtattcatcatataggcttcctcgggtgtaatctcgaacaggttgtcccggccaccgaatatctctgtgatcaggccgaagctctcagagtgcaggaatccttggcggtagactatggcgcggctgcggcctacgggttggaaagcgcagtcgaggtggagcaccgagcgcatgggatcggtgtcgtgcttgatcagctctatcggtatgatggtcttgtgtgggaaaaattcgcggaagaagtctacagcccgtgcattggttcgggccgtcttgaaggaaggataatccttctgaaggtaggtgcctatgaaaagaatatcgtcatataacaggatgtctccgccttcggcatgaatatcttcgctaaggcgtaccagatggctctctccgacacaatcccaaatgggcgaaaaggcttcggactcgcgggcacgatcggctatcaggttcgatacgaagagtttgtcatcgatggcaaaagccacatcgcgggcaaatatctggttgtagtttgctatcggctcgggacggagcacctctatgccatgacgcaccagtacatcgagtacggcatccatttctatcttgatatcctcgtccgaaggataagtgccccgtaacacggattcataactcttggcatcgtaggtgtcggcgagagcaggtgctccgccggtcgaatccggcaaccccagtacgacagtgcgcaagggagccgtttcgttggtaacgtgtggtagtatcttcatcattaggattgcctgcaaggataaaaaaggtcaggcttccggcaaagataataaagagaagagagtattccgcgccgtaaccggtaataaatccgaatcttatttccctttcgggcatatctttattttctcacaaggagctacacgaaccgatgaaaagagcttcctactgtcggaagattacgagccaaaaacggtcggattgcggtgcgtgttttggcgaaaacacgcgcgagaaatttttcgttttggttccaaaaatttttacttctcgcgccacaacgaaaaaattttcgcgccacgtcttttccaaccgtattccggctttttctcgaacgacaaaagagaaaaggtgtctatgtgccatcggtaacttcggacacgtggcggatgcctcatcgagtaggccaaaaatgcctacctttggggcagttgtaaaaacttaatatcaatatctaacaagaggatacagcgatgaaattctttatcgacacagctaatttggatcagattcgcgaggcgaacgacatgggtgtcttggacggcgttactaccaatccgtctctgatggcgaaagagggtattagtgggaaagacaattgcatgaggcactacttggccatctgtgagattgtcgatggagatgtgagtgccgaagtgatagctacggactacgaaggtatgattcgcgagggcgaggagttggccgctctgcatccgcagatcgtggttaaggtgccttgcacggccgaaggtatcaaggctatcaaatacttcagcgataagggcattcgtaccaactgtacgctcatctttaccgtaggccaggccctgctcgccggggggccgagtccaaa

SEQ ID NO: 853 - DNA (genomic), 824 bp, PORYPHYROMONAS GINGIVALIS; double-stranded, circular
  misc_feature 1...824
  hypothetical: NO
  anti-sense: UNKNOWN
gccgggaatttgtctcccaactccttcaactgcttttccgtctggaagatcatgctgtcggcctgattgatcttgtcgatacgttctttctctttcttatctgcttcggcattggcctgcgcctcttccttcatgcgcttgatctcatcatcggacaaaccgctggaggcttcgatgcggatattctgcttcttgccggtagctttgtcatgagccgttacattcaggataccgttggcatcgatgtcaaacgttacttcgatctgcggtgtctgacggggcgccggagcaataccgtccaagttgaaacggccgatgctcttattgtccttagccaaagaacgctcaccctgaagtacatgaatctctaccgaaggttgattgtccactgctgtggtaaagatttcgctcttcttcgtcgggatagtggtattggcatcgatcaagcgagtcatcacgcctcccatagtctcgataccgagcgacaagggggtaacgtccaacagcaagacatcctttacctcaccggtcagaacaccgccttgaatagcggcacccacagctaccacttcgtcgggattcacacccttggacggagccttaccgaagatcttctccacaatctcctgaatagcaggaatacgtgtggaaccacctacgagaatcacttcatcgatatcgccacgtgacataccggcatctttcaaggccgtttcgcagggtgccacacatgcctgaatcagacgatcggccaactgctcgaacttagcccttgtaagcgtcatcaccaagtgcttggggatgccgttcaccggcatgatata

SEQ ID NO: 854 - DNA (genomic), 762 bp, PORYPHYROMONAS GINGIVALIS; double-stranded, circular
  misc_feature 1...762
  hypothetical: NO
  anti-sense: UNKNOWN
gattagtttttgtttcattcgaatgaggtagtttttgtatttggagacagatagttacggagccaagcggtgaacagaccaggaagcatcgggccggagttcgtacaggaagcgatcgtgcaagcggctttcgcgcccttgccaaaattctattcgtaccggcttcacggcaaagccaccccaagtgtcaggacgtggcacagtccgaccggcatatttgagcgactccttcatgaattcctgtacgatgaaagaacgccccggtataggacgactctgtggcgaaatgcgcgcccctacccgacttttgtacggacgtgtagcaaaataagcatcgctaagctccggctctaaaatacgtacatccccctccacatgtatctgacgctccagttcgtgccagaggaatgtgagacagacgtgcggattggcagccatttgctgccccttgcgactctcatagttgctgtagaagataaattcgttgttcataaactccttgagcaaaacggttcgcgtactgggatgaccgtcaggagtagccgtcccgacgataacggctgtaggctcatatgttttggcttcgaccgcatcttgcaaccatctggtgacaaggtcgaaaggagtaggtgtcaggtcgctggcggaaaggcttcgttgtcatattcccgcctgatattttcgaaatgtaaatccatgcttttgnggnttttattgtccggacaaagttatgccattggaatggtcgttccaaaatccttt

SEQ ID NO: 855 - DNA (genomic), 3145 bp, PORYPHYROMONAS GINGIVALIS; double-stranded, circular
  misc_feature 1...3145
  hypothetical: NO
  anti-sense: UNKNOWN
tgcttaatagtttccatagagtccgtacctcgtttttgcagacgagaacgcagctcttctatagaaggaggcaaaataaagatagccaatgccctatctccataatatttcttgatgctctgtgctccaacgacatcaacgtcgaaaatgacatttttctcttctttcaggatccgctctacctcacttttgagcgtgccatagtatttgtctctgtacacctcttcgtactctacgaattcgttggcctctattcttcgtctgaattcttccggagacaagaagtaatactctcgtccattctgctcttctccacgaggtgcacggctggttgcagaaatagagaaatgaaggttaagctctctgtccgtaagaagtcgttcgataacggtgctcttacctgttccggatggggccgagatgatgattagtttggtcatggggaattttgtctaaatatgtagtggaatggctataatacgttcagtacttgctctttgatctgttctaattcgtctttcatctgcacgacgatttgctgcatctccacatgattgcttttggagccgagcgtattgatttctctgccgatttcttgtgcaatgaagctgagttttttcccttgtccgggctcgccttgcatggtttggagaaaataagaaagatgattccgcaagcgatgcttctcttcatttacatccaacttttcgatataataaatcatctcttgttcgaatctgttcttgtcgtagtctttctctgatattttggttaggttctcttctatccgctctttgattcgttggatcctatcgggttcatactgttcgatttgcagaagcaaagaagagatattagatattttctccgtgaacacctgctccagcatagcaccctcctgctcgcggaatccgattagctgatcaagggctctccgacaagtttcaattacgacagcccattcatcttctggaatttcttcttctttatcttcatctatctgaatgactccggggatccgaagtagctgttcgaaccatcctcctgcgggtacttccactcccatcttttcgccgaattccttgagttggaagaaataagaggacatcttttctgtatcgaatatctgagatacaacatccgtactaccggattcctcgagaaacaagctgaaatccactttcccccgtccgatgtcggccgaaaccaaagccctgagaggtagttctctatcacggtaacggctggaaatcttggttgatagatcgaactgtttgctattgagcgacttgatggtcgcagttatttttttatcggcgaattgaatcgtatgcttgccgaatccggtcatagataggatcatagtcttttttatatgcggttaggagagaaaaaataaaaagagaatcacagactattctataccatagtcggtgattctctcataaatctttttacaggttacgcccgtggcactgtttgaactttttgccactaccgcaaggacaaggatcgtttcgcccgatcttattctcgtttcttatcggtgtctggggagcagctgcaccctgaggtctgcttgccgcatccctttgtgctttctgctgggcttctatatcgtctttttgtgtccgatacttactcatgtccgtacgttgttcggctgcatgtcggatttctatttgccgcctgtgttccagctcttcttgggaaggagcctccggtaccggtatccgagcacgcattaggatcgctacggtcttacggttcatggcttctaccatcttgcggaacagttcgtaagattcgagtttatagataagtagtggatctttgttttcgtagctggcattctgaacggaattacgaagctcgtccatctcacgcagatgttctttccaagactcatcgatagtatgcagtacgatagctttctcaaattctttgatgatgcttttcccttgagtttcatccgcttcacgcaaattgcatcctatgttatagacacgtttaccatccgtaatggggattagaatgcgctcgtacacggcggcttgggtctcgaatacctgatgaaccacagggtgggccacttctgcgatcagatccatcttacgttggaaagacttgtaagcttcatcgaaaagcatatcggtcagctcttctgctttcttacctctgaatatttcttgcgtgataggagattctatcgcgagtgcacgcatcagatcttccttgaagccttcgaaatcattggcttctgcataattgtcaatcagagccttacatacgtcgtatatggtattgagtacatccataccgatacgctctcccatcaaagcatgacggcgacgggtataaatgacttcacgctgcgaattcattacatcatcgtactcaagcagatgtttacggataccgaagttgttctcttccaccttcttttgagcacgctccacggacttactcagcatgttgttttcgagcacttctccttccttgaaacctaaacgatccatcaatgatgcaatcttttctgtggcaaagaggcgcatcagatgatcttcaagggaaacatagaatatggacgaaccgggatcaccctgacggccggaacgaccacgaagctgtctgtccactcgtctggattcgtgcctttccgtaccaatgatagccaaacccccggctttcttaacctcggcagagagcttgatgtcggtaccacgaccggccatgttcgttgcgatggtaacagttcctttctgaccggcctgagctacaatctcggcctccttctgatgcaatttggcattgagtacattgtgttggatgccacgcaagcgtaacatacggctcaacaattcggatatttccaccgaagtagtaccgacaagtacaggtctgccctcttcgacaagacgtacaatctcttcgataactgctgcatatttttcacgtgccgtcttatagatacgatcattcatatccttacgggcgataggcttgtttgtcggaataactacaacgtccagtttgtagatgtcccaaagctctcccgcttcagtttcagcagtaccggtcatccctgccagcttatgatacatgcggaaatagttctgcaaagtgatagttgcaaatgtctgtg

SEQ ID NO: 856 - DNA (genomic), 480 bp, PORYPHYROMONAS GINGIVALIS; double-stranded, circular
  misc_feature 1...480
  hypothetical: NO
  anti-sense: UNKNOWN
ggccactgtcgtgaaatctgttcctccgttcgggtgctatgggctttatcttctccattgtcggtgtgatcatctttacgggccttaccgctttcgatgtgaacaaaatcaagcagatgctggctcaaacgcaaggattcgaagagggagatgtagttcgcaaagtagccctgatgggagccttgacgctctatctggatttcatcaatcttttcctctatctgcttcgcttcttcggccgaagggactgaatccctcccattgaaaagacaaagacaataataaaaatccctgccaacttggatcgttggcagggatttttcattgaaacaccgttagtcnatagatcgtcntacaactacattgacgatcctcccggggactacaatgacttttttcggactcttgccttccanccaacgggctgcttccgggaacaataaggctgcttgctctacatcttctttgctcatatcgggc

SEQ ID NO: 857 - DNA (genomic), 3049 bp, PORYPHYROMONAS GINGIVALIS; double-stranded, circular
  misc_feature 1...3049
  hypothetical: NO
  anti-sense: UNKNOWN
ccgtggctcaaaagctcttcccagccgcgctcggtgttgtcttccgctttctctaccggattacgcagggcacgatcccctccggcgatcagcccgatgacgaatgtggggggcataccgaatgtgggaggaatctccgaagcatccaggacgcccaagcggccgctggtgccggctcccatgtagaagagtcgcccaccctgctccatgcgtggtatgatttgttcgaccagtcgttcgatcatcggaatagtccggctgacggcttcggccactttcctgtcctcgcggttgatgtcttcgaggatctctctggtcgacttttcttccagtcggtcgtacagggaaggctgttcggtaatcttctcaaacatgattgttgtggtgatattgtataagtccctccatcggactttgcagtaccgatccgagcgttaagcctctttttttgatgacgctactcaacacttcccgataatgaaaggctacagagccgatgaagtggagggggagatcaggacgattgtatcggagcacgttgcgcacaagaaagtcgtcgaaactattctgtacaaggctatatacagccggaatgtccaaatgctgcgcgataaagggggagaatccggccaagaagcgattggggaaaggctttcgatagacactctcgataatatcggcagacgtcaggccatactcctgcaggaaagcttcgcacagcccctccggcatctgccccttgagaaggctgccgatgaacagccgtcccaatacggctccgctcccttcatctccgaggatatagcccagtggggaaacgttggctttgatctcccgaccatcgaacagacaggaattggagcccgtacccaatatgcaggctatcccctcggaatcgccacagagagcacgggctgcaccgagcatatcgccggcgacttcgatgcggtcgcagtggggcagcatactgtccaaggcttcatttagcataggggctttggccggtgtacaccctgcaccgtagaaatatacagctcggatagaggaggctttttggcctatggccggcaggacttccgaacgcagggcagtgtctatttcgttcctatcctgctgaaatggattgatacctgacgtttggaatcgtccgaggctttttccctccttggctatgcaccaatccgtcttggtggaaccgctgtctccaatcagaatcatgatcgtatttcttttttccggctcaacaatgccaggcctatggcggtaaagaaggcattgaagatgaggagttcgtaactgaatttatagccgccgaaccattgctccgaatggctctggagaatgtagcagagcaccggagcaacaagggctgccagagggacgtatctgtcccgtactgcccttttggtggcgatgccgaagaaaaacagtcccaatatcggcccataagtgtaactggccagtacgtagacggcatcgatgacgctcgtgttgcttaccatattaaagaagtatatgaccagccccatgacgacagccatgccgatgtgcacgcgatggcgtatacgagccgattgctcttcgcttcggtggctgtgtgcttggaggatgtccagcgtgaacgaagtagtcagagccgtcagggccgaaccggcttgcagagaaagccgacgacaccagtcccaatatgaacaggatgcctccaacaggcggaaaatagctgcccgtggccaagagtgggaatagctcatcgctttggacggatgggggatgccgtggctgtcggcataggtatagagcagggtaccgagcatgaggaagagtgctatgatgaagaactgcatcacgccgccggtgaggacgttcttctgcgaatcgcggtagttcttgcagctcagattgcgctgcatcatgtcctgatccaaccccgtcatagctattacggtgaatacgcctgccagaaactgcttgaagaaatagcgtttgtcgttcacgtcatcgaagaaaaacatacgggagtagtcgctcccgccgataaggtcggtcgcccctccccatctgtcgcccaagtcggcagaaatatagacgatgcagagtacgaccgagacgatgaggcagagggtcttgaacgaatcggtccagatcagcgattttactccgcccttgaacgtatatagccagacgaagagcatcgtcaggcacacattggccataaaaggccatccgaacggttcgaatacgatcagttggagcgtcaggcatacgagaaaaagccggacagccgcaccgagcatcttggagatgaagaaaaaccatgcccccgtcttgtaggacgagaatccgaaccgctcttgcaagtagccgtaaatggacatcagattcatccggtagaagagagggatcaggacgaaggcaataatcagttgtccggccacaaagcccagtaccatctgcaggtaggagaatccgctgccggccaccatgcccggcacggatacgaaggttactcccgatataccggagccgatcatggcaaaagccaccatgtaccacggggatttgcgattgcccacaaagaagccggcattatccgctttgcggcccgtgacaaaggaaataccgaaaaggaagacgaaatagacgataacggtcagaatagctacgagaggactcatatcaaatcattgagacgttaggaacagtattttcttaaactctctgcaaagctacggaaatacgtcaagtacttcgcaaccagcataacagacttccccgtgagttgcatggtcgtgctagtgaagatatcttcagcagacttcgggctacaccataggggttgtcgggctatgctgtagagcttgtcgagccacgccgtagaggccggatcgttatactctacggcttatctcgttatgttctaaggaattcctcgttatcccttacggattatctccctacgctctatagctcatttccatacgctctaggggatagccaaaacacaccgttcagcaaggaaaagaggggcgaaaaaaactgtaaaaacgga

SEQ ID NO: 858 - DNA (genomic), 370 bp, PORYPHYROMONAS GINGIVALIS; double-stranded, circular
  misc_feature 1...370
  hypothetical: NO
  anti-sense: UNKNOWN
tgggttaagcgtacatatatacaaaggtagcacagtttttaattaactttgcgtaatagcgtctgtaaaacagattggctaaagatgttatttgagtctttctttgtagatcgaaaaaagatatgaaacagacttttcgctttatcaaaccaattgaacggattactcacctgaagccgaatgctacgatgatgttgttcttggcttcggtgttggcagtcatcatggctaatagttcgttgagtactatctatcatgaaattttagagtaccctatcaatcttacgatcggaggtcatgaggtcttttctcatcatggagagaccatgaccttgctccagtttgtgaatgatgtgctgatggtcatttc

SEQ ID NO: 859 - DNA (genomic), 932 bp, PORYPHYROMONAS GINGIVALIS; double-stranded, circular
  misc_feature 1...932
  hypothetical: NO
  anti-sense: UNKNOWN
agacgtacattcacggggaaaccattcatagcacggaagatacccttgaagtcttcctgctgataaggcaggatcttggccaaagcacgtacgcgaccttctgccgtctcgctcagaatcatttcgcgcatggctttgatcttctcgccttcgaagaacatatgctccgtacggcaaagaccgatacctacggcaccgaagctgcgagctatctcggcatcgtgaggagtatcggcattcgtacgaactttcagcttggcatacttatcggccaaagccatcagatcggcgaaatcttgatccatttcggcggctttcgtctccacctgtccttcgtatatctcaccggtagaaccgttgatggagatgtagtcgccttctttgaagagggttccatcgatctctacggtacgtgccttatagtcgatgttcaatgcacctgctcccgatacgcagcatttgcccatacctctggccactacggcagcatgcgaagtcatacctccgcgagccgtcaggataccttcggcggcagacataccggccaagtcttcgggcgaagtctcgatacgcaccatcaccacacgcttgccatcctctttccactgagcggcatcgtcggcgaagaaaacgatctgacccgtagcggcacccggcgaagcaggcaagcccttggtcagtacacgtgctctaaggagagcagacttgtcgaaaatggggtggagcaattcgtccagcttgttaggttcgacgcgcataagggcttcttcctcgctgatcataccctgacgcaagagatccatggcgatcttcaccatggcacaacccgtacgcttaccgttacgggtctggaggaaccagagcttaccttcctgtacggtgaactccatatcctgcatatcgcggtagtgatcctcagtttctgctgcagg

SEQ ID NO: 860 - DNA (genomic), 775 bp, PORYPHYROMONAS GINGIVALIS; double-stranded, circular
  misc_feature 1...775
  hypothetical: NO
  anti-sense: UNKNOWN
attatattccaaaacgtaatttctcctacgaaaaggggaagcaagtactgcgcaatgtatcgttcacggccaaacaaggagaagtcacagccctcgtcggtccgtcgggtggaggaaagagcacatcggccaagttggctgcacgcttttgggatatagatggaggaaagatctttttgggaggggaagacatttcgcaaatcgaacccgaaaccctgctacgtcattatgccatcgtcttccaagatgtactgctcttcaatgcatcggtggccgataatatccgcataggtaaacctgatgctacagatgaagagctcaaacgtgtagctcggttggcaagatgcgacgaatttgtagatcgtctgccgaatggatatgacactttgatcggtgaaaatggtgagaacctttcaggaggtgaacgtcagcgcatttctatagccagagctttactcaaggatgctccgattgtgctgctggatgaagctacggcaagtctcgatgttgagaatgagacactgatacaggccggtatatccgaactgatcaaaaacaagacagtcctcattatcgctcatcgtatgcgcactgtagccaatgcccataagattgttgtactcaaagaagggactgtagccgaatgtggcagtccggccgaattgatggccatgaacggtgtgtttgctcgaatggtggcggcgcagaagtaaggaaacgtgagttcgatgtaagcgatatggtgccgactctcataagatccgccatatcgatc

SEQ ID NO: 861 - DNA (genomic), 685 bp, PORYPHYROMONAS GINGIVALIS; double-stranded, circular
  misc_feature 1...685
  hypothetical: NO
  anti-sense: UNKNOWN
gggaattttcaagaaaccgattaaaaacaaattaatcggcggcatcgcatcttctcccgatagcctgctctattcgatgcccgatcacagaagtctgacggtcgggggcagcatccgctataatcctgcaccctattatcgtttggacaaggacggacgtaagcggtatgacggggtcggtacacgcgctccgctatttgggctcacttaccgtcaagccataccgctcggacgagagcacgacagcgactacatctacctatccggttcggtacggcaaaatctccgactcaatccgttgcactcgctctactaccacttcacggtgggcagttactttcgtcggcatacggtacacctcgacgaacagcgctatctcaaagctgacaatgctttgtttcaaataggaggcacgctccacgacagtttccaaaccctccctccttattcttatacggatcagaactttctcatccttcagactcgctggtctttcccctcattgatcactaatnccgntggggcatcctattcgcttcgttccagtccaaccttcatctgaatacgtattggggatgccacaaagaccggatgcctttcttcgaaataggctattctcgtggtacgatcgcacaaatcggcatcttctgtggcgcatacaatttccataaagattacggcctga

SEQ ID NO: 862 - DNA (genomic), 3363 bp, PORYPHYROMONAS GINGIVALIS; double-stranded, circular
  misc_feature 1...3363
  hypothetical: NO
  anti-sense: UNKNOWN
gtctcctataaggaacggagcttttcgatggcttcctccctcgtataatggggcggacggaacaagccttttttgtccaaaaacttgcggacaaaccaatcggcgggcttgcgttcccccttgacatagaagcatccgcagaagagaccaccgcctcttagcacgcggaaagtctctgcaaaggcacggtccttgtcggggaagacgtgaaagccattcatcgagagcacgaggtcgaaagccgcatcggggaaaggcaggctgccgacatcgccttgccggagcgatacgttggttatttgctctgcactgaagcgcatcgctgctatgtcgagcatttcctgcgaatagtccagcccgacaatctcggcttggggcatccgcctgtatttgtcataggtgaaaatggctgttcctacggggacgtcgagtattctgccctcgaagttgccgggaatcatgtccagcaccgagcctgcgatgatattgtcgtccgttttccagagacagtgcatatagagccaagaccaccatttccgtccggtgaggacatcgtcgtagtggttagtcagtcggttataggcgtttttctgcttcatatccattcttgattttgttcgacattctgtcccttatgctatcacttgggtataccgaaagccggtatccatgcatcgagccgattaaggcaaaggattgtataggaagaaaaatccatcctgagatttcgattgttaaaaactgctctatgcctgatacacaaagatatagggtttgcccacagcatacaatcgctaaaaatggtgattttcacagtcttctttcgcccattttcttcccgtttctcccgatcggtaccgactccttgtaaaaaacgacagcaaacgatccaatccggatgtgtcctaaaaaaaattgaatccaagagcaaaaaagacagcaggggaaggacgtccggtgcgttccttcccctgctgtagttttatgatttgtaacctgtcggtcagagaatcgaatcgaggagactttcgtctaccagatatggaattgtgatatggtatccatccgcgtgagtcgtattgaactcttcgcttactgtcatggcattgggattgcgtgcccatgagcgtcgggccactccgcccattacatcccaaagcatggccgagcgcaagatggcatccacacgttccgaaccatcgagcaccatgccgaatccgccgttgatagacttcccgatacctacaccgccgccgttgtgcagagccacaaggctcattccgcgagcagcgttgccggcaaaacactgcacggccatatcggccatcacattgctaccgtccttgatattggaggtctcgcggaaaggactgtccgtaccgctcacatcgtgatggtcacgtccgagcatgatagggccaacctcgccacggcgtaccatttcattgaagcgcagtgctatgttcattcgtccgagtgcatcctgatagaggatacgtgcctgtgtacctacgacgagctgattcttctcagcatcgcgtatccagatccagttgtcgcggtcttggtcgcgtctgtccggatcgatgcattccatggctgcatggtcggtcttgacaagatcctcatgcttaccgctaggcatacccagcggaaggggccatagccgtagtcgaacagctcggggcccatgatgtcttcacgtagctcggccagataaatccgtcctatcgtcgattctgtcttgctgatctcgataataccgtatcgatatgctcttcatgaaagcattgccgtagtcgaagaagtaagatccgcgtgctaccagagctttcaccacttcgaaatgacgtttaagtccgagatcgacctgacggcagaattcgtcgcgatcctctttgagcaggcgtgtacgctcctcgaaagagagtgtcaccggacagtagccgccttcatatacggcatggcaactggtctgatcggaaaggagatcgatatgaataccttcgctcaaagcatattcgagcaggtctactacattgccatgataggcaatagaacaaggttcgcccttcttccgggcatcggcagccatacggaaagcctcttctttcgactcggtacggaacttgacccatccctgtccgtgacgggtatcgatacggctactgtccacttcggccgttatgctgacggctcctgcaatatcggcagccttgggctgtgcaccgctcataccgccgagaccgctggtgacgaatagtttgccggccaaattgcctcccgtggggatattcaatttctgacgaccggcattgagcagggtattgaacgtaccgtgtacgataccttgcggcccgatatacatccagccaccggcagtcatctgtccataattggccacacccatctgggcagcgatctnccaatccttgatatggcatacaagccgaccatcatggaagttggtgatgatcacgcgcggagcatcaggcttggacttgaagagtcccaaaggatgaccgctttcgatcacgagtgtctgctcgttggtcatctctcggaggtacttcatgatgagacggtactgcatccagttctggcatacctgcccggtctctccgtaagtaacgagttcgtagggatagagggcgatgtcgaaacagagattattgtcgatcatcacctgaaaggcctttccttctatacaccggccttcgtactcgtcgatgcttttggctttgagatccccttcgggacggaagcgatagccatagatctttccacgggttctcagctcctcgaggaattcgggagcaagctccttatgcaactccacggggatataacgcaatgcattcttcaaggccgtgcgtgtctgtgaaggggtaagacggaagccgcggtcaggagcgcggcgaatacctgctacaaacttgggataagcaggcagcgtattgtccagagtgaacttcattatttgatattttgtgatttgtagtcagtaccaagccttagagaaagtgtccatcgctaaggcggtgccaaattaccatttttcgaacaccgagccaaaaaagtctctaatacggtgccaatcacaactttgcatactagagaaaaagctcggcaaataggctatcgactcatccgaaaaatatgcataacaatcgcaagctccgaaagccttatggcgaaccaacaaaaacgaagacagccacctcgtttgcaaagcgaacaaggtggctgtcctatatgtatgcagggctatggaaaccccttatcctcagagaacgggaatcgacgaagtcggcgggctataatctgcgtcttcnaagtgtacttctctgtgaacgtttcanc

SEQ ID NO: 863 - DNA (genomic), 2886 bp, PORYPHYROMONAS GINGIVALIS; double-stranded, circular
  misc_feature 1...2886
  hypothetical: NO
  anti-sense: UNKNOWN
atgtaacggcccgacatggtggaaaatacgaagcagcagccgtcggagaggtgaacgtggtgacgaagatgaaagaaatcggcgccctcatcggaggagaaggcaatggcggagtaatccttccggagcttcattatggacgcgatgcattggtgggaatagccctattcctcacacatatggccaagcgcaaggaggcggtgagccgcattcgagccgaataccctgcatactttatgagcaagcagcgagtggacacccctgcaggtaccgatacgcagcgtctgcttcagaccatgttcgaaaggtataagaacgaacagatcagtaccgtggacggcgtgaagatcgactttcccgacagctgggtacatatgcgcaggagcaataccgagccgatcgtcaggatctacaccgaagcccgtacggaaaaggaagcacaggacttggccgatcgtttccgttcggagatagaacgagaattgtaagccggctccttcagaatcaagacaacagcttaacagatcattcattggcaagaaagaaaaaagagcttcccctcattacaggggtggaaataacggatctggcggcagagggcaatgctctctgccgcattgatgatatggtgatgttcgtgcctttcgctgcaccgggcgaccgttgcacggttcaggtggtaaagaaaaagcgcaacttcatgcagggacgaatcgtctcgatcgaaagcccctcaccgatcaggaaaggacctttctgtacgcacttcaccgtctgcggcggatgcaaatggcagcatattccatacgagatacagctccgagccaaggagcagcaggtgaccgatgcactcgtgcgtctgggtaaggtggaggtggaggagatgcagccgatcctcggatcggagcagacggagtactaccgcaataagctcgaatttacattcagcaacaaacgttggctactgcccgaagaggtacaggaagtcgatggcgacttctctcccgaggtgcgatacggacttggattccatatccccggcatgttcgacaaggtattggacattcgcgaatgccacttgggggctaaggtatcggacgaaatacgtctcttcatccgcgaatattgcatgcaggatccggagcgttatcctttcttcgacctgagaaatcaggaaggcctgatgcgaacgctgatgatccggactacatccacaggagaactgatggtagtcgtggtcttctttcgcgacgatgttgctgctcgagaagctctgcttgcggccgtggcggaacgtttccctcagatcacctcgctcctctacgtgatcaataccaagtgcaacgacacgataggcgatcaggaagtgctcctgtaccatggcagggaatacattgaggaggagatggaaggactgaagttcaagatcggggcttaagtctttctaccagaccaatagccggcaggcctaccaactttatcggatagcgcgcgaatttgccggtctcacaggggacgaactggtttacgacctctataccggcacggggacgattgccaacttcgtagccggacaagcccatcgggtaatcggtatcgaatacgtacccgaagccattgaggatgcccgcacgaacagcctactgaatggaatagagaataccctcttctatgcaggagatatgaaagacatcctgaccaacgacttcatcgaacagcatggacgtccggacgtcgtcattacggatccgcctcgagccggcatgcacgagagtgtgatcgatgccatcctctttgctgcacccaggaggatagtctatgtcagctgcaatcctgccacacaagcccgcgatttggctctgctgatggcagatggcagataccgagccgtaaaatcccgtccggtggatatgtttccccacacccaccacgtagagaatgtggtactcctcgttcgaaataccgaatagaggctccgtgaagtcctccgacctgtaaatatcgggccgacggacttgatactataaacccttccgattttatacttaaaaacccattggagagatctgacaaatccttgggtagatcgagaaaaaactactagtactaaatgtgttttctgtagaaagtgacgcgagaattttggcgcataaaccagtccgatatgaaatggcgtatgttgcattttgccccacatcgctcatcggaaaaatggaacctatgaccaatccggttttaattgctctcttttttgttcttttgtgcagaaacaaggttgtaggacgatgatacagctaactacccccgttgagaatccggtaataagagagaggttgatctcttatgccaataagctctttttcgttggttcctgtttcagtttggaagttggttcctatatgcgtcaagccggatttcgcacagagatcaatccttttgggatcatgtacaatcccctgtctattgccggatgtatcggccgattgctcgatcctgtaccttatcaggcagaagagttgttcgaatacgatggcttatttcatagtttcgatcatcacggagctttttctcatgcaaaaaaagaagaaaccctgcagcatctcaatgacagcctacatgtcggtcacgaggctttgcttcgttccgacaggctttctacttacgtgggggacgggctttgtctacaactatgtcagtgccaataaggtagtggctaattgtcataaactgcccgaacgcctctttcgtaggcagatggtcggcattgacgacttactggccgtctggatccctctcatagagcgactgctgagttcttctcccgatcgtagaatcattcttacggtcagccccgtacgtcatcttcgcgatggagctgtaggaaat

SEQ ID NO: 864 - DNA (genomic), 903 bp, PORYPHYROMONAS GINGIVALIS; double-stranded, circular
  misc_feature 1...903
  hypothetical: NO
  anti-sense: UNKNOWN
ttgctcttaagacctgcaatgccatcattattgccccccaccccagatccaaaaaatgctctgcacacgcagttcgtctgatcaaagaagctatcgctccgttcaacgtaccggaaggtatggttcagatcatcgaagaacccagcatcgagaagacgcaggaactcatgggcgccgtagacgtagtagttgctacgggtggtatgggcatggtgaagtctgcatattcttcaggaaagccttctttcggtgttggagccggtaacgttcaggtgatcgtggatagcaacatcgatttcgaagctgctgcagaaaaaatcatcaccggtcgtgctttcgacaacggtatcatctgctcaggcgaacagagcatcatctacaacgaggctgacaaggaagcagttttcacagcattccgcaaccacggtgcatatttctgtgacgaagccgaaggagatcgggctcgtgcagctatcttcgaaaatggagccatcgcgaaagatgtagtaggtcagagcgttgccttcattgccaagaaagcaaacatcaatatccccgagggtacccgtattctcgttgttgaagctcgcggcgtaggagcagaagacgttatctgtaaggaaaagatgtgtcccgtaatgtgcgccctcagctacaagcacttcgaagaaggtgtagaaatcgcacgtacgaacctcgccaacgaaggtaacggccacacctgtgctatccactccaacaatcaggcacacatcatcctcgcaggatcagagctgacggtatctcgtatcgtagtgaatgctccgagtgccactacagcaggcggtcacatncaaaacggtcttgccgtaaccaatacgctcggatgcggatcatggggtaataactctatctccgagactt

SEQ ID NO: 865 - DNA (genomic), 5688 bp, PORYPHYROMONAS GINGIVALIS; double-stranded, circular
  misc_feature 1...5688
  hypothetical: NO
  anti-sense: UNKNOWN
gctcctcatcgaatgattcggtcatctctgtccgaacctcctgaatgttattttggagttgttcctgcttattgcggattccccttaatgtaaaccggccttccgatccgacagtagatgttgccatcgggcgcgtcggaggtaccactttcgtctgttcgggcttgtcttccgtgatagttggagcagtggtctcgggttggcgtcgctgctccccgatactcggctgaggtgggacagaggactgtgatggagcaacggatggctgctctttggccggagccggccggggagataccgatccgctcaccacgggatttgcgtgctgtgctccatgggtcggaggcggagcagtcagtcccttgctaaataaagccgcgatattcatcagcgacaactccaacaacagacgcttgccattgctctggcgatactgctggtcacaggcattcagtatcttgagcgattggtataagaaagaagtcgggcaacgtgctgccatatccacatatcgctgtatgactacttcggactgctccaacagcggcaaggtagaagcgtcctgagccatcatcaaatcgcggaagaaagaagccaatccgctcacgatcacctgtccgtcgaatcccttggcaagcaattcgtccaacacgatcaatacggatcggtaatccccctgtaaaaagaaatccgtcagacggaaataataatcgtagtcgaggatattcagattctctatcgtattggcataggtaatattgccttccgaaaaacgggcaatgcggtcgaagagcgaaagagcatcgcgcatccctccatcggcttttgtcgctattatagccaaagcttcggcttcggcttttatcccctcgctgtctgctacgtagcgcaaatgttgctctattcgggcccgtggtattcgtttgaagtcgaatatctgaccagcgcgagagaatagtgggcaggatctttgtgcttctctgtggtagccaatataaagatcacataagaaggcggttcttcgagagtcttcaggaaagcattgaaggcttgctgcgagagcatgtgtacctcgtcgatgatgtagatcttgtattttccgatctgtggcggcacattggcctgctctatcaagagacgaatatcatctaccgaattgttcgaagcggcatccagttcatatatattcatggatcgctgctcatcgaaagccttgcacgactcgcatcgcccacaagcttctccatccggcaaccgctccagacagttgatggcacgggcgaagatgcgtgcacaagaggtctttcccaccccacgcgggccacaaaagagataggcgtgagctgtcttttgctgtacgatggagcttttgagtgtagcggacaatgcctcctgaccgaccatcgaggcaaaagaatcggggcgatatttgagtgcagatacgatgtatttcgtttccatgagccgagcctgtttgcttaggaaacaaaggtaaactaaaaagaagcagcagaggctatgccggagagcgaactctcgcgacatagcctcacgatgctttcagtgaaaaaaaacgtacaatatcaatgcaaggcacaacccttacacttctctcttatctgagtaaagaaatcattgcccttgtcatctaccagaataaaggccgggaagtcctccacttcgatcttccaaatagcctccatacccagctcgggatattccagacactccactttcttaatgctgtcctgagccagaatagctgctgggcctccaacactgccgaggtagaatccgccgtacttcttacacgcatccgtcacttgctgagagcggttgcctttggctatcatcaccatactgcctccatgcgattggaagagatccacatagctatccatacggcccgctgtcgtaggcccgaacgaaccgctcggcatccccttcggtgtcttggccggaccggcgtagtagatgggatgattcttgatatagtcgggcaaaccctcgccacggtcgatacgttcttttagtttggcgtgagcaatatcacgccccacgataatcgtaccactgagagacaaacgggtggaaacaggatactgcgacagctctctcagaatctcaggcatcggacgattcagatcgaccttgaccaccgtaccctctgtaccctcacgcatggattcagggatgaggcgtgtgggattggtctccatcttttcgatccagataccgtctttattgatctttgccttgatattgcggtctgccgaacaactgacgcccatacctacgggacagcttgctccatgtcggggcaggcggatgatgcgcacgtcgtgtgcgaagtatttgcctccaaactgagcacccagtcccagatgataggcagcttccaagacttctttttccagttcgacatcgcggaaggcacgcccgccttcgttgcccgaagtaggcagattgtcgtagtacttggccgaagccagcttgacggtcttgaggttcgtttcggccgaagttccgcctatcacgaatgcaatgtgatacggaggacaggcagctgtaccgagagaactcatcttatccacgaggaagttcaccagcgtcttggggttgagcagtgctttcgtttcctgatagagatacgtcttattggccgaccctcctcctttggctatgcagagaaagtcgtactccatgccgtccacggccatcaggtcgatctgtgcgggcaggttgcaccccgtattcacctccttatacatatccaaaggagcattctgcgaatagcgcaggttctcctgcgtataggtatcatagacaccatgcgagagctgctcttcgtcatgaccgcccgtccagacctgctgtcccttcttaccgaggatgatagccgtgcccgtatcttggcagaaagggagctgtcccttggctgaaacctccgcattgcgcaggaaagtcaaagccacgaatttgtcgttttcgctggcttccggatcggacagaatccgagccacttgctgctgatgctccggtcgcaaatagaaagcgatgtcatgaaaagccgtccgcgcaagtaatcgcagagcttccggctccactttcaggacatcatgatcgccaaacttgtccacggacacatactccttcgtcagcaaataatactctgtcgtatcatcccccatagggaaaggcttctgatacttaaattctggagttgccatagtaattgtaactattgttattaaagtgataatcggttcttttttcggtctcccatcgaggacatttccttatcgatgcatttggagtatttcctctgcggaggcatttgctatttccctgagacaaggcagacagagacagtcatgataatgtcgtcgaaggaattcgaagtgatgcgattgcagttgtaccgtcctacagtcgcatcgcatatcgggaagatcatgaccgcacagaaagcctctcccacaacggggacagactttccggcggtagtttcccgaaagattcaggctcatatctcagtgggcatcccggccaatgatcgcttgtatccatccaccagatcaaccatgatctcggccaccgtctccgcatgacttatctgcgatactgcctggcctatctccaattcgccctcgtgcaggtcgccttcgaaaataccttgcttggcacgaccacgaccgagcagctcgcgcagctcttccacggaagcaccgcgctgctcggcagcgaatacatcctgatagaatttgttcttcagcagtcgcgtaggcgatacagccttgagcgaaagcatcgtatctccctccaccgaccggcggcaatgtgccttaaagtcttcatgcgccgaactttcctcactcagagcaaaacgggtccccacttgtacggcatcggcacccaaagccaaagcagcggcaactgcacggccggaagcaatccctccggcagcaaccacaggaatgttcacagcatccactacttcaggtatcaaacagagggtcgtagtctcctctcgtccattatgtccgccggcttcgaacccttcggccacgatggcgtctacaccggctgcctctgatttgcgagcgaatgtggcactgctcactacatgtatcaccttgctaccggcagctttcaacttggctgtccacacctttggactaccggctgacgttaccactacgggcacatgttccctcatgataatctccatgattttgtccatctccggatagagaagaggcacgttcacaccgaaaggcttgtctgtagcagctttacacgaacggatgtgatgctccagattgtccggatgcatggatccggcaccaataagtcccaaaccaccgcagttgctcacagcagaagccagtttccaaccgctgcaccacaccatgcctcccgatatgatcggatgttcgatacccaataattcgcaaattctattcattttcttattcttcttattttgtattgtatctgttattcatttctcatttggtcgtctgatccgatccttcttcaaggcatcttaatcttatttagtaagtaaaccgtactcgctttttcaagtttttacggcacacacaacatagtcacaaaaataggaacaaaagccgacttctacaccctgctatttcgatgcctatgagaaagaatctcccgaaccgccaaatcaaatgcgacaacccccatgcagaggcctcgacaaattccaaacagcttcgacaaaaagtgagaggaaatcgaaaaataatttcaacacagcctctttataattaaatccggctttcaggagaatctcaaaatatagagggtgagccaaaattttcattttgacacaccctcttcgtccgtcttatgtagtaggatcagtgtaagatcagaagtttacacgaataccggtagaccaagtgcggccgaaaccgtaccatacgagagccgaagcctcatcgtgtttcttaccgatgatattgtcgtcggcatcgctcacatatcgcttgtcggctacgttgtccatgttgaaatagaatgtggtgctgagtgaaccaagcttgaaattgtaggatgcagacagatcgaacagacctacatcgggcaacttccatgattccacgatttctttgccatccgcttcgtactgctgtgcattacgcgttgcggggttgaatcctgcatagttcttgccaaggaagttgtacttacctatgacatggaaacccttgaacagctctatgtctgccgatacagcagccgtcatctgtgctgcatctccgacgtgaagacccttgatataggttatatcctgccctgtctcattgccggcttcgtcgtaagaagtgtaacttacattgttttgccaagtccagtcaccgagagagaacataccgcgaaggtcgatctgacgaataggacgatagctgacctcagcctctaccccacagtgaacagcatcaacgccattgagataaacatactcgtttccgattctcttcgaggtcacgcgatccatccacttcgtatagtatccgttgatattgaactcgaagtttttgtgattcgtgaatccatagccgacctctcctgtaagcaccttttccatattggctttgtcattgggaatgatagcccccgcagcatagatattgccaaagagtggtgcacgtgtga

SEQ ID NO: 866 - DNA (genomic), 429 bp, PORYPHYROMONAS GINGIVALIS; double-stranded, circular
  misc_feature 1...429
  hypothetical: NO
  anti-sense: UNKNOWN
gctacagacaccgtgtcagcaagctgatgtttctcggcagcacctgtatctacccgcgcgatgcccgtcagccgatgcgtgaggaagaattgctgacagctccgctggaatataccaacgagccatacgccatagccaaaatcgcaggactgaagatgtgcgagagcttcaacctccaatacggcaccaattatatagcagtgatgccgaccaacctgtacgggcccaacgacaatttcgatttggagcgaagccatgtgcttccggccatgatcaggaagatttacttggccgatcgcctgcttcgccacgatgaggaaagccgttccgcacggatttgtccatacgtcctgtcgaaagcatcgacngatcttcttctttcaatgatattctctcattgctgaagcggtacngcatcaccgccgaaaa

SEQ ID NO: 867 - DNA (genomic), 868 bp, PORYPHYROMONAS GINGIVALIS; double-stranded, circular
  misc_feature 1...868
  hypothetical: NO
  anti-sense: UNKNOWN
tcgatgacgaactcgtcgtagacgatatgccggctgacagtctctccgccgacatggccgaatcggacagctcggccggcgtcttcgcccgtgctgcccatcatcatcccgtcctcctccgtgccaaactcgacgagcaggctgccaccgaccgtttgcgagccgcgcgaggtgcattcctgccgagtgtgtcggtatccggaggatggaacacgggattctcacgctttttgaatggatcggactatacgcccttcagcgagcagtttcggaaccgtcggggggaatacgtcagtctgaatctgagtatccccatcttttcgggattcagccttgtgagccatctgcgtcaggcgcgtgccgaacgcagggcggcaatcgtccgacggggcgaagcggagcgcaggctctacagcgagatcgcccaagccatggccgaccgggatgccgctctggcttcctaccgccaggcgaaggagcataccgacgccatgcaaaccgcttacgaagccgtcttgcagcgttatgaggaggggctgaatacggccatcgacctgaccactcaggccaatcggctcctggatgcccgtgtgcagcgactgagagcggccatgacctaccggctcaaatgcaaactcatagcctattacggctgcctttcggactaaagcttttcttttctcccgttcgtatcaaatcataccatcatggatagaaaaatagaaaaaaagaagacgctcatcccccgtaaatattatccctatgcagggggagcaatagtaatactcgccttggcggcgtgggccgtattcggcaatcacagcaccaagttcagagccgaacgcgcttcggattcagcattcgacag

SEQ ID NO: 868 - DNA (genomic), 1492 bp, PORYPHYROMONAS GINGIVALIS; double-stranded, circular
  misc_feature 1...1492
  hypothetical: NO
  anti-sense: UNKNOWN
tcgacttcgagctcggtaccctgcaaggagcattttcgcctaccatatagggaatgatgtgactcgatgatggcatttctatgccttttcccttgatagcatcacgcaaaagcgtagcagaatcctccagccgctttctctccatcacaaactcaggtagccgacggaatatcagttcagtccatcctatcgtagcaggtggtaaagctgtggagaatataagcgaacgacttcgattgatcaggtattcacgtacgacattgtcacagactatataggcacccatagaggccaatgcttttccgaatgtgccgaccagatagtctattttcccaatggtagcagtctcttccgccaagcctaaaccggtttttccccttactcctatggcatgagcttcgtccacatatagctcgacggtagggtatagctctttgagatcaaccaaggatgggagatcggccacatcgccgtccatactatatatactctctactgctatgatgatccggctgtatagatctttattcttgtggaggatccgctccaaatgctccggatcattgtgccgaaatcgctcgaaaggcgttccacagagtcggatgccatctatgatgctggcatgaactaatctgtctggcacgatcaaggtccgttcatccacaagagccggtagaacgcctgtgttgaggtggtaaccgctgttgaatatcagagaagattcgcgtccgaatcgttccgctatcatcctctccaatctgtcatatgccgtactattgcccgtgagcagacgggaggaacagctgcccggaagtcgatcctctccagagatagaggtataaaactcatctatcagatcttcccgagcagtcagtccgagataatcgttcgaggagaggttgagcattcgtctttcctcctcgatgatgtagctgccatcgtgtatcagattcctaagctgcctgagactcccgctttcttccagctcttgcagctctgccctatatttttcgttcattcaggttttttgattgtctgttccgattttctgagtattgtattcggagcgattatgctgtcaggtgataatgagatacaaatataaacaaacgggaaagacccgatttatagatttaacgtcagttcggcgtaagaaaacgccaatgtattcgttccaagattagcggttaacgcactaatattttggaagttataggttgttctgttcaggcaattgtatagggggcaatcctgcttctgcctggatcgaaccaacattgaaattcggattgcttttgaccgaatgttgcagtccgtatagggagatgggctataccacagggcagatggcggtactccgtagaggatgacgagctatcccgtacggctcttcgagctacgctgtagagctcggcgaggtacgccctacagcgtagcgagccgagccgtagagttccgctccgtgagccgtagaggtggccgagctgagccg

SEQ ID NO: 869 - DNA (genomic), 3142 bp, PORYPHYROMONAS GINGIVALIS; double-stranded, circular
  misc_feature 1...3142
  hypothetical: NO
  anti-sense: UNKNOWN
gcaggcggattcatcacagacctgaagatcggctactggctcggcaccacgccgaagagtcaggagaagtggaagttcctcggcgttctggtagcttcggtcaccgtagccggtgtgatgatgatcctgaacaagacctatggctttacgggcgatcaggctctggtggctccgcaggccaatgcgatggcagccgtgatcaagccgctgatggaaggcggtaatacgccttggattctctatggcgtaggagctatactggctctgatcctgacgagtataggcgtgcccgcactgccttttgcactgggtatgtttatcccgttacaactaaatacacctctcctcatcggcggactcgtcagctggttcgtcagcacccgctcgaaggacgcttctgtcaataaattccgcaaggaacgcggtacgctcatcgcttccggattcatcgccggaggagctttgatgggtgtggtaagtgcgatcctcaaatacatggagttcgatgcttttgcccaagaatggcacgccatggcaggcgccgaatggttggccatcggcatgtatgcgctcatcattctctacttcatcgtcgacagcatcagaggcaagaaacatgaagcataacaacgaaacaaagaatatggaactgaaagagagatttctccgatatgtaggcttcgatacgcaaagcgacgaatcctctaccactttcccctcgacggacaagcaattggtgctgctgcgtcatttggccaaagagatgaaggacctcggcctgtgcgaggtcgaaatggacgagcacggctatgtcatgggcagcatccctgcctctcccggttgtgagcatgcgcccgtgatcggattcattgcgcatgtggatacggcccccgacatgagcggcaaggacgtgaagccgcaaatcatcaaaaactataatggcggcgatattcgtctgaacgaggaactgactatgcgtgtagcggatttccccgagttggcgttcttcaaagggcatacgctgatcactacggacggtaccactctgctcggtgccgatgacaaagccggtgtggccgaaatcatgacggctgccgagtatctgctcgcacatcccgaagtcaagcatggcaagattcgcctcggatttactcccgacgaggaaatcggtcggggagtggatcacttcgatgtcgagcggttcggtgccaagttcgcttacacgatggacggcagtatggaaggagagttggagtatgagaacttcaatgcggcttcggccaaactgaccgtaaacggacgcaatatccaccccggctatgccaagggaaagatggtcaattcgctgcaggtagtgtgcgatctgcatgctcttctgcccgaggctatgcggccggaggctactgccggctacgaaggatttttccaccttatcggcatcaacggttcggtagagaaagcatcggcatcttatatcatccgcgatcacgaccgcaaactctttgaagagaagaaagagctgatcaaagctgccgtagactacatcaaccgcaagtacggctcggacatcgtgtcgctcgaactcaaagatcagtattacaatatgcgagagatggtagagcctcatcccgagattatcgaaaaagccattgctgccatgaagcttgccggcataacggccaaggtgcagcctattcgcggcggtacggacggggccagactctcttatatgggactcccgtgcccgaatatatttgccggtgggatgaacttccacggcaagttcgaatactgttcgctcgactccatgcggcgggctgtggacacgatctgccatttggctgctctttgggctgaatagtcatcgcacgaatgacgatccgttcttccctttcttacgatcattaatagagaatggtttggggcctcggagggaaagcctgcacaattgggttttccctccggcatttcctccatccgattcatttgtatgaaaccaaacttttccgaacgttacgctcgccagacggctcttcccgaagtgggagccgatggacagcagcgattagatggttcgcatgtccttgtcataggagccggaggccttggttgccctgtcctgcaatatctctgtgctgcaggcgtggggcatatcagcgttgtcgatgatgatcgcgtcgacatcagcaatctccaacgtcaagtgctcttttccgaagccgatttgggacagcccaaagccattgcggcagtagctcgtttgcaggcgatgaatagcgattgccgtccggaagctttcaccgaaagatttacggagctgaatgccgagatgttggccggcgagtgcaaccttattatcgatgcttcggacaatgctgagacgcgctatttgatagatcgtgcttctcttgctctcggaattccttggatatatggcagtattgccggatggcgcgggcaattcactgtcttcggttatggccatccggtgcgttattcggatctttttccctccggcgaagcggctcccgaggaagtgcccccagccgttatcggagccttgcccggtgccgttggatctatgatggcagccgaagccatcaaaatcctcttgggaagacccgccgaagaaactctcagtggccgtctcctcctcatggatctgttgcatggcgagtcgcgcactatccgctattagcaatcctactaatctgcttaatcaaaataattccgattccccctccccaaaaaccatgtccttcaatctgatcgtcgatcaaggccaattctgcctgtaaggttgctttcgtccgaaataatagtatagagagcatttcctttctgccgggaaaagccggacaggcactcagccatctcgtcgctcctcaccgtttcgacaaggctatctactcatctgtggggcttcccgacgaagaggctgaagctattgtgagaagttgtgcagctgcttccttgatgatggggactgagacccccgtaccccttcgcctgcaatatgatcgccgcactttgggtgccgaccgactggctgcggtggtcggagcgcatagtctctatccgaataccgaattgctggtgatcgacgccggtactgccatcacttatgaacgagtatccgggg

SEQ ID NO: 870 - DNA (genomic), 858 bp, PORYPHYROMONAS GINGIVALIS; double-stranded, circular
  misc_feature 1...858
  hypothetical: NO
  anti-sense: UNKNOWN
gcacatggtatcgttgtccatattgtccagcatgattatgtctgcaccatagcgtactgcttcttcgacctcagccaaattagacgtttccacttccagcttgatcgagagagggagtgctcttctcgccgcttcgatggcttggggtatccctccggctaccttgatgtgattgtccttgagcataatcatatcatagagtcccatgcgatgattatgtccaccgccatggcgaacggccatcttgtccgttattcgcataccgggtgccgtcttacgggtatccaaaagccttacagccgtacctttcaaagcctcggcatagcgagcggtcatagtggcaataccactcattctttgcaaaaaattaagtgccaatcgttcggcttgcaacaaagcccggtaactgccttccacacgcaggattacttgaccgcgttttacggagccgccatccgatacatagggagtccaagtcacggcttcgaatcgttcgaagacacggcgagctacctccatgccggatatgatgccatcagccttcattaccattgtggctgcagctccttccgattgggggataatggcattggaagaaatgtctccatcggcaatgtcctctgcaattgccagatcgatcaatttttccaaaagcatttcttcatgagtcataacttaaaagtgatgagggtattacggatgtttatttggtatttcccgctccgccggcaagggtgtaagaggagtgcttgcgataggcttngctcgtatcgggatagtcttcccgatnatgccctcctctactttctcggcgagctatcgccccccgaacgatgagctgacccactgtcagcagct

SEQ ID NO: 871 - DNA (genomic), 2860 bp, PORYPHYROMONAS GINGIVALIS; double-stranded, circular
  misc_feature 1...2860
  hypothetical: NO
  anti-sense: UNKNOWN
accctgcctaaatcccggaaaaacggcgcgagaattttttcgctttggcgcgagaattttttgcttcccgaaccaaaagcaaaaaaatcccgcgccacgtcttcaggagcaacaaatgcaaaaattttggcacgtaaacaggcccaacggagatgatgcccgggcttttttaatagcagtttgtatagggcattgtattagccataagcatagctcctgagtcattcccataaagacgggcagttaaaatccgatcacctccccatatccactcattatttgtacgtaaatgtcttttttcagactttaaatacttatatttatcccgaaaaattacccaagagagattgggtcgattgtcgatccgtcttaagtcatacaatccaataatcattattgaaatgaaaaaaacaaccattatttctttgattgtcttcggtgctttctttgcagccgtgggccaaaccaaggacaattcttcttacaaacctttttcgaaagaagatattgccggaggagtttactctctcccgactcaaaatcgtgcgcagaaggacaatgccgagtggcttcttacagcgaccgtctccacaaaccagtctgcagatactcactttatcttcgatgagaacaaccgctatatcgctcgtgacataaaagccaatggggtaagaaaatccacggactccatttactacgatgccaacgggcgaatatcgcatgtggatctttatatctcgttcagtggcggagagcctgcactcgacacccgattcaagtacacctatgatgacgagggaaagatgaccgtgagggaagtattcatgctggtaatggatccgaatacacctatctcacgcttggaatatcattatgatgcacagggcagactgacccactggatttcttttgctttcggggcagaatcccaaaagaatacgtatcactataatgaaaaaggtctgttggtcagcgaagtgctgagcaatgcaatggggacaacctattcagacaccggcaaaacggaatacagctatgacgatgcagataatatggtgaaggccgagtacttcgtcgtccagcaaggaaaggcatggcaagtactcaaaagagaggaatacacctatgaggacaatatctgcatacaatatttggctattaacggtaccgacacaaaggtgtacaagcgagacatcgagagcgataagtccatctccgcaaatgtcattgacattccgtcaatgccggaacagacctggcctaatatgtacggattcaacgcaaagcgactgaaagagacttattcctcctacgaaggagatgtggctactcctatattcgactatatctatacgtacaaggctcttacctcaatggcaacaccttcgacagaagctcaggtagcagtctatctcaatccgtcaacggaccggttagtgattctggccaacggcatcacacatctgagcatgtacgacttgcagggtaagcttatccgtgattgtgccttgagcggcgataaggtggaaatgggtgtcggatctttgaccaaagggacatacctgcttaaagtgaatacggatcagggagcctttgtgagaaaagtcgtgattcgatgatgtagttcggatcgaatttcgaagaaaggagctgtacgacaaggcccccccttgcgtacagctccttatttcattgggatcaaactgtctccttgtcgctccccggcatggcaaggagtttttgccgatattgggagggagagcagttcatgtagcgtttgaaggtgcgagagaagtaagccggatccgaaaagcctgcctcaatgctaatgtcggagatgtttttgctctcatcggcaaggagcttgcaggccaattttatcttgatctgctgtatgtagccgatggtggagcaacctacgacactcgtgagctttctgttgagttgggatggactcatgcacattttttcggccaagtcttgagcggaaaaatccggattttgtttgattccaccggacactgcatctttggcagcaaggagaaactgcatactgctgtcatctatcggttgaggctcctcctccggcttccgatccagcatgagtttttgcatatagaacttcttgagcaactcacggtctttcagaagctgctcgatccgcatcaaaagctcctccggagagaatggcttgcatagataagagactacaccgcttttgattccttccaatctgtcctgttcggtactcttggccgtcaaagcgacaatgggaatgtgacagagcagaggcgattgcttcatccggattgtcatttctatcccatccattatcggcatcataatatccgtaatgataatgtcgggaatatgctcggtagcgagggctataccctcttttccgtttgcggcggatagcacattgtagcgatcgcaaaggagtagtttgacgagcaggttgatatccttattgtcctcgacgagcagtatggtcggacgttcgtcctcgaagcgatgattcagagctgctaccatcggagatgtcggtgagtcatcgggcgcgatgtggacaggcatgacaatgtcatcggaggagggtagccaaggaagaatctctgccgaagaggactggttttgtgtaggaatactgatggtgaaggcacttcctttccccggctggctttccactttgatcgtacctcgaaggttttcgaccagtatattggtaaacgagagtccgacgcctgatccatgcttttcggtagcggactgtcctcgatagaagatgtcgaagatatgagcctgatcagttttatctattcctatgccattgtctgcaacgcgtatgatcagatttttt

SEQ ID NO: 872 - DNA (genomic), 349 bp, PORYPHYROMONAS GINGIVALIS; double-stranded, circular
  misc_feature 1...349
  hypothetical: NO
  anti-sense: UNKNOWN
ancctctcttatattcacttggcccacttagtcctgagataatattaacgtcagttcggcgtaagaaaacgccaatgtattcgttccctgattagcggtttacacactaagatcttgggagttataggttgttccgttcaggcaattgtatagggggcaatcctgcttttgcttggatcgaaccaacattgaaattcggattgcttttgaccgaatgttgcagtccgtacagggagatgggctataccacagggcaagatggcggtactccatagaggataacgggctatcccgtacagctcttcgagctacgctgtagagcccggcgcggtgagccctacagcgtagc

SEQ ID NO: 873 - DNA (genomic), 470 bp, PORYPHYROMONAS GINGIVALIS; double-stranded, circular
  misc_feature 1...470
  hypothetical: NO
  anti-sense: UNKNOWN
ggtacccgcgaacggtagccgtgtacacctgatccattacggctgagaagacttccagcaggagactgttcttgagcgtatattccacatttccggacacgacatcgaatatagtagtcgaaggagtatccatttccttctcgaacttgcaatcgatctttcccgaacgggcagccggtacctgagccttattcatcttatcgccacgcttgaggttgggcaatgaagcaagataagtttcgatcaatggcttcatcttggcttcatccagattaccgataaagaagaacataaagtcgccggcatcagcgaatcgctcattgtagaaagccattacctgatcgtaatttactttctccacgtcagcagctttcatgggtttcatcatcggattatcgccgtacatggtatgacggatagagtccataagcgcagccatcgggttggcttcctgatttttcaagttattg

SEQ ID NO: 874 - DNA (genomic), 2556 bp, PORYPHYROMONAS GINGIVALIS; double-stranded, circular
  misc_feature 1...2556
  hypothetical: NO
  anti-sense: UNKNOWN
atgcttcgccatccccttacgtggaccatacttgccacctttttggctgtattgtcatatctcttttataagagatacaaggagaaccaagctcgccgtcctgtggtgacacctgaggccccggctattccggcttatgaccgagctattgcagccttggaatcattacgtgcaaaaaaactggtggaagccggtttgtataaggaatactttacggaattgaccgatttgcttcggagctatattgccgaaactcgcgaaatagatgccagggagatgaccagcagcgagatattacaagctcttcagcggatcgaacttcctgaaaaaggaagtcgcctgctgcatggaatattgcaaacggccgacctggccaagtttgccaagtataaaccgatacatggagaggatgtggaagctattcgagatgctcgcgcctttctcgatgaggtgcataatatccgggagtcatgacatttgcatatcctgaattgctttggctgctgatcctgctgcctttgatagcgacttggtatatcctgcaagcacgtaagacttcggcaacgatgaccatatcttcattgaagccctttgaaggaagtcgccgaggtttgagggtctatctgcgccattcgttgccgatattgagagctctttcggtcggttttctcattattgctttggctcgtccgcagaataccaatagctggcagaaagattcgatcgagggcatagatattatgttggccatggatgtgtcaggcagtatgcaggccatggacttcaagccgaatcgcttggaggcagccaaagatgtagcgatttcctttatcaacaatcgtccgaacgacaatatcgggatggttacattcgccggagagagctttactcaatgtccattgactaccgaccataccgtattgcttaatatggtacaggacttgcagatgggtgttctggatgatggtacagctatcggaatgggattggctacggccgtcaatcgactgaaggacagcaaagccaagagccgcgtggttattctgctgacggacggatcaaacaacatgggcgacatcacaccccgaatggcagccgatattgccagaacgttcggtattcgtgtgtacacagtcggtgtaggcacacgaggagaagctcctttccccattcagacggaattcggagttcggattcagaatgtgcctgtcgatatagacgaacccacattggacggaattgccgaggtatcgggtggaaaatacttcagggctgtcgataatgaaacgctgaatgaaatctacaaggaaatcgacaaattggagaagacgagacttatgaccaagagcttcaaggcttatgaggaaaaatactttgtctatgcccttattgcttttctcttgttgctgacagagtttttgcttcgcaatacacttcttcgttccaacccgtaaaaagattcccatgttcagattttattcacccgaatacttatacttactgctgctgctcccattgcttgtgggggtaggcgtctatgcttatcgcaaaagacgggcgcaagaaagaccggtttgcccgaacttccgctgctaaggctctcaaaccggaagcaagtaccaaacgtcggatctggcgcaacggatttcttcttcttgccatcgttttcttgatcgggatgcttgcccgtccgcaaataagtattcgtgtggatgtgcctaaagaggagaaaggtatcgaggctatgatttgtttggatatttccaactccatgctctgtgaagatgtcaagcccaatcgtttgagttttgccaagcaagtgttgggaaagctctttgacggcttgcagaacgacaaggttggattggttgtattcgcaggtaatgcttatacgcaaataccgattactacggatttgtctgcagccaaacagtttcttgcagatataagtcccaatatggttacagcccaaggaacggctatcggagcggctatcgaacttgcctccaaatctttttccgataataaggaaatcggtaagactatcattgtcctgacggatggagaaaatcatgaaggaaatgccatcgaagcggcacagcaagcccatgaagcaggcatacgggtcaatgttattggtctcggaacagccttgggggcacctatacctattgaagaaggatacctcaaagatgaaacgggcaatcctgtcgttaccaaattcgacgaaaagatgtgccgtgacattgcttcagcaggagagggtactttcttttccggacagagtgcttctgcgctggttcgggctatagagagccagctggacaaactccccaaagccgtactttcatcttcgtcttcttccggctatcgcgaagtgtacggatggttcggacttgcggctttgatatgtttattgttggaattcctgattcaggagcggaagagtaggttcttcagtaggatcaaattgtttgacagatgagaaattcatggcgatatgccaccttcataaccttcttcatgcttcttgcttcaacgagccgggtaccgagg

SEQ ID NO: 875 - DNA (genomic), 4760 bp, PORYPHYROMONAS GINGIVALIS; double-stranded, circular
  misc_feature 1...4760
  hypothetical: NO
  anti-sense: UNKNOWN
cccggaaaaaaatgtcattggaggagattgcccgcagtatcgaacattatcccacacgctttctcatttggacaggtggagaaccgactctgcaacttacagaagaagctacggcttattttcacaggcttggttactttcaagctatagagaccaacggaactcgccccgtacccaaaggtatagactatatttcctgtagtcccaagaccggagccataggaaaactgaaagaaaacttccctgatggagtgggggagtttcgcttcccgttaggatccgatactcctctacctccaccgatcgatgaattgcccactgctcagcattatcttgtcagccccatcttcgcgggagacgatgccatggagcccgatccttctgccatcactcgctgcgtcgagttcgtcaaggcttttcctgcttggcgtctgagcatacagatgcacaaactgattcatatcccatagcctatcccttttcttcttaatatgtacagcggacatcataaaatccattatccttttcttatcctgttggtatgccttgcttttgctgcctgcaagagcgtgaagttgaaagatgcggagaaggcacatgatcgccaagagtataccaaggctgccgatatgtacaatacattatacaggcgtacccgacgaaagcaggtggagatgaaagcttatacggctttccgatccggtgaaaactatcgtgccgccggcagacaagccaaagctttgcgtggctatctgaatgccagacgctacgggtatccggattctgtggtactgctccgtttggcacagacttatcagcaaggaggtaactataaggaagccgaggtactcttccgtggatatctggaagcttatccgaaaagttattttgcagctatcggtttggaggggtgtctctttgcccgccagcaaaaggaatatcctacacgttaccggatacggcgagctgccgagtggaattcggcacggggcgacttcggcccggcctatgcacccgatgcttcggctctctatttcacatcgagcagaagcaaagacgacggtttggataatagcagcataacgggactgaaacccaacgacatttatatcatcaaacgagatgcacaaggacgatggggacgtcccgatagcgtgtccggaggaatcaacactccatgggatgaaggcgtgccaacgatcacgcccgatggtagtaccatatattatacgttggcgcagcaaggagccgattacgaccgtacggtacagatctattccgccgctcggagcggagaaggcggttggagcaacggttcgctcgtggacattatgcgcgattcgctccgtatggctgctcatccctctatgtcggcatccggcgattacctgtatttcgtcagcaatataggcggtagctatggcggcaaggatatttatcgtgtcaaggtgtcggatcgttcttatggttcaccggagaatttggggcctgatatcaatacgccgggggacgaaatgtttcccttcatagatggggatagtacccttttcttcgcttcggacggacacgccggtctgggaggactggatattttcaaagccacgctggactctaccggccaatggcatgtagtcaatatgggacaaccggtcaattcctctgccgatgatttcggcttggctgtggagcctaaaggcaaaaacaaagaagaagctttgccggacaacggagtcaaaggtgtattttgttccaaccgaggcgatgcacgcggatggccgcacctcttccatttcgaactgccggctatctacaccgagattcaaggttatgtgatggacagagaagaaaatcccatagccggagccactgtcaggatcgtaggcgaacgcggccccgtaggacagggattcgtgactactcgtgacgatggctcctataagatgagcgtgcagggcgatactcgctatgtaatgcttgccggagcatcgggttatttgaatcagtacgtagaactcaagaccgataccgccaagcagagtgagacctactatgtggactttttccttgcatcgcgtgagaaagccgagggcttgcaaaatattttctatgatttcgataaagctactcttcgccccgaaagcatgaagagcttggacgaactgattcgtatcctcacggacaatccggatattcggatcgaattgggttcgcatgccgacaggaaaggccccgatgcttacaacctcggactatctgaccgcagagccaaatccgtggtggattacctcacgagtcgtggcatagcggccgacaggcttacgtggaaaggctacggtaagtctgtccccaagacggtgacagccaaaattgccgaacggcacgatttcctgaaggaaggcgatgtgctcaccgaggaattcgtagcacctttgaccgaggagcagcagtcagtctgcgaccaactgaaccgtcgtaccgagttccgtgtgatcgaagaagagttgcgttaatcgctcgtggaatgaaaagtagagcggtcaaagccgtaccaagtgtgctttgataagacttaatttttcagtacgtcgaatctgatattagtttcagaaaaatctactagtggtttcagaaaaatctacttgtggaaatctacgtctctttaatgagtgcccctttgagacaccaaacgacatgaccggcaacagcacttgtgcttctccaaccatcgccttgctccccgtgtatgcaccttgtgcgccacgctgtaccgtctgattcacattgcgtccatacgagccgataccacctccggctccaataatccatccggctaccttcggcacacagtaatagccagcaataccgattaggagaaactcgctcgaatgaaaccgcaaaaccaatttaatgcgtcggccccgggggcaacctgtcagggcgatcgcgtttaaaaatttttagtctctttcctctatgatttgaatctctgacatatgaattcgcacttgtttgataatcgggtgtagcaatcatgagctttagatgcacgttagtggctgaaatgcgattgccctgatcaaaaatagtactacgaaagttttgtaccttagcgcgcatgaaaaagaccaatctgtttttatctctgctggtgatctttatcaccggtagttttatgactgcctgtgcacagaagtccaagacgaacaaactcaccgaagaagatcggagccgcaatgagtatgtacagtcgatggatgtgcttagcaatattatcggtaacgtcaggctgtatttcgtcgataccataagtatcaaacatatgactcggcgtggtatagatgcgatgttgggcgggcttgacccctataccgaatacattccttacgaggaaatggatgaactgaaattgatgactacgggagagtatgccggagtcggagctatcatatcgcagcgcccggatagtgctgtgattatccagagacctatggaaggtatgcccgcagacgaagcaggattgatagcaggcgaccgcatcctgactatcgatgggaaagacttccgcaaatccaccacaccgaaagtaagccaagcactgaaagggatagccggtactgttgcaaaggtgacagtaatgcgctatggcgaaaccaaacctcgtactttttccgtgaaacgtcaaaaagtgattatgaattccgtcacttacagcggaatgctcgatggctcgataggatatatccgcttgaacaactttacggacaaaagtgcagaagaggtgcgcacggccttgttggatcttcgtgacaaacaaggagcgaaaggtctcattttggatttaagaggcaatggtggcggactgatgcaggctgctatcgagatagtcaatctgttcgtccctaagggcaaagaggtggtaacgaccaaaggtcgcattgcagagtcggcgtccgtatttcgcacattgactgaaccgatcgacacgaaactcccgatagtagtcctgatcgatggacaatcggcatcttcctcggagattgtagccggagcactgcaggatatggacagggctgtactgatgggacaaaagagctatggcaaagggcttgtacaaacgactcgtcagctaccatacaacggcgtgatcaaattgactacggccaagtactacatcccaagcggacgttgtattcagcgtttggactacagccgcaccaatcggacaggtatggcaacggccattcctgacagtctgcacaaaatcttttacactgctgccggaagacgtgtagaagatgcaggaggaatcctgcctgacatcgaggtcaaacaagatacagctgcgacattactttattatatggccatcaataatgacgttttcgatttcgtcacaggttatgtgctcaagcataaaacgattgccaagccggaggatttttccataacgaacgaggactatgcagctttctgcaagatgatggaagaaaagaaatttgactatgatcgccagagtggcaagatgcttgacaaactggaggaactggctaagatagaaggctacctgccggaagccaactcggagcttaaagcactacgcgaaaagctaaaacccaacctgtcgcgtgatctgctacgattcaaaaaggagataacaaactatctcaacaatgagattgtcactcgctattattatgagcgaggcagtatccgccagagtatgccggaagataaggtagtcaaagaagctattaagctgc

SEQ ID NO: 876 - DNA (genomic), 2476 bp, PORYPHYROMONAS GINGIVALIS; double-stranded, circular
  misc_feature 1...2476
  hypothetical: NO
  anti-sense: UNKNOWN
cgcgaggccgagatattggctatcaccaaaaaagcatgcgaataacgatggcacgtacctcttttcaagttggttccgaaccgctctctctggatctgcttcgcgaatatctggatagtcgcttcaagctggaactctcagcccgatgccgtaagacgtatcgagcactgccgccactatctggacgagaaagtgaagcagtcggacaaacccatatacggcgtgaccaccggcttcggctctctctgcaacaggacaattacaccggatcagcttaccgncttacaggagaacctcgtcaagagtcatgcctgtagctgcggcacgcccgttcatgaggacatcgtgcgcctgatgcttctgctcaaagctcatgccctccagttgggacacagtggcgtacagctatgcaccgtgcagcgtatcctggacatgctcaataacgacgtactccccatcgtttacgatcgcggttcgctcggcgcatcgggcgacctcgcccctctggccaatctcttcctgccgcttataggtgagggagaagtcatgtacaagggagagaagcgcaatgcctgcgatgtgatgcaggagttcggctggaagaagatcatcctcaagagcaaagaaggcttggctctgctcaatggtacgcagttcatgagcagtcatggcgtctacgccctcctcaaggcacaccgtcttgtagaggtagcagactgtatcggtgcactctcgctcgaagctttcgatggcttggatgccccctttaccgacaacctccacatcatacgtcctcaccccggacagttggccgtagctcgtcacctgaaggaagttcttaaaggtagcgagcagatagcccgcccgaagaagcaggtacaggatccgtacagcttccgctgtatgccgcaggttcacggagccagccgcgatgccattgcctacgttacagaggtagtcattcgagagatcaactccgtgaccgacaatcccacggtcttccccgatgaagatcttgtcgtatcgggtggtaacttccacggccaacctcttgccatcgtatatgattttctggctatagccttggctgaactgggcaatatcagcgaacgtcgcacggctcagctcatactcggtctgcgcaatctgcctgagttcctcgtagccaatcccggtctgaacagcggattcatgataccgcagtatgcagccgcagctatggtgagcaagaacaagatgtactgtttctccgcagccagcgatagtatcgtcagcagcaacgggcaggaagaccacgtttctatgggagctaacgcagcaacgaagctgcttccgatcatagaaaacctggagatgatcttcgccatcgaactcctcgatgcggcccaagccttcgaattccgccgtccgaccaagacgtctccgttcttggagaagatgctcggcgagctgcgcaaggtagctcccaaggtggaggacgatgtagtcatgtacaaacagatacaggcagccacggagttcgttcgcgaatatgctttctaacgaaccccgcttctcccgctgattccttacgctgaggagagggagatacaggctttccgaatgcaagaaagagagagtgtgccacgaagtattttcgtttggcacaccctcttctcgtataggctctctccgacgcaataagggtaatgcccatgcccgtttacaagacatgagatcagactaaacaatcgaaaacaaacaatgacaaaagaaacataccccaaagctactgtcctcgacatatcggcatcagtagagtattccgacggcggaatcatcagcaaacaagtacttaagaacgaagtaggcaacattactctcttctccttcgaccaagggcagggattgagcgaacacacagcacctttcgatgccttcgtacagatattggaaggggaagcggaaataagaatcggaggccaacctcttctcctcaaagccggccggtccgtcatcatgccggccaacgtcagccatgcactccatgctacgaaacgcttcaagatgctcctcaccatgatccgcggctgaaaacgggcagacatatactgcgccatcctgtggacgtaaagcctccaacaaataaacaaaggagaggagatctgtacatgccgacagtctcctctcctttctttttcttcctaacctcttgtctaccttgcgactgcctgcctcttgcgcatcatgagtttgtccacgatcagcgagatagcaccgtcgcctgtgacattacaagccgtaccgaagttgtccatggttatatacaatgctatcatgagtgcctgtaaggactcatcgaaaccgagcatactctgcaaaacacctaaagccgccatgatggctccacccggcactcccggagntgccaccatcgtaataccgagcataaagataaatccggtaaacagacctgcatcataaggcatcccctgca

SEQ ID NO: 877 - DNA (genomic), 3611 bp, PORYPHYROMONAS GINGIVALIS; double-stranded, circular
  misc_feature 1...3611
  hypothetical: NO
  anti-sense: UNKNOWN
taccccctgattgatcagctccgttatatcgcgagatattttctccacatgttcgatgtcctgtgaggtcaccgtaactgtctggctgagcagatacccggcaaaggtcctgacgttttgttcctgccgaggatcgtaatagtagttgtattctttagagatggctacgcttgagaagatataagacgaatcgggcagctgcttgtttttcaaatagtctgctaccaatatctgtttttccttcaaagccttgtaggccgattcgagatccatcatctggagctggtacgaagcagtccaaacgatcagatcggatttgaaattacgctcggccataccggtcacagtcaccgaaggctgagagcggcgtagctgagcgacactgcggccaagagcataaaggcccaatacgaaagccaaaccggcgacgatcgcaatccaaagtttttcttttttcatcacaaagcactgtattgattctatattactacttcttatcgccatagaatacaggataagcaaagtaatgcgtttcccaccgacgagtccagatattgtattcgcgctccataccgacggcaaagccgaatcgctcggagactttcagctcaagcgatccaccgtactgagggccgaatccatgcatcggaacagccatattgagtcctgagcgcgtactgctgtagagaggatagctgccaaatccattgacaaagacattgtccatcacttcgtatcgagcacttcctttaagcgagaacgttctattatcgaaagcattccactgtacctgtcgataatcgataccggtggtaaaactcaatctctcggtggcttgccaacgcagttggccattgacagccgtcataggtataaagccgaaattctgctgccaaccgccttggacatgtgccgtaagattttgactcagcaagaagtcggcaccagcattccatccgaagtccttgcgcacaccggtcaataaatcatggccaagaccgatattgcccgatgtataaaaatgcatcctatcggtcggtcgccatgaaaggacaccggcagcgtggcgagtttgcaagaggggagaaacgaaatcccgacgctctgccgcgaagttgagttcctcattcaattgcaaagatgagcgatgaggcttcaatccattgagcaaagcatcggaaagatgtttgtctctaaaccttttcagtgtacgggtattctgaaaagaagcgggcaggacggggtgatcaatggagagaagaggggtctgctccaccatgctgctattcggcactggctgaaccgtagagagactatcctttttctcttgcgccatcgcagagaaaagacctaccacgaatatcaacccgaacaggacggttctcggacgacggataagacaccggattatcatgagtcttgcataatttgatataccgcaaagataaattattataggtacaacagacataccgtacaggccctaaaggttatccccaatctacaagacgaagcagacaggaggaggaaaagaaaggctaagccgacaaaagagaaggatacacatcctatactcagttgattttcacaccgaaattttgcatttacagcccaaaaattctgtttgattggtagccatatactggaggcttgaccttttccgaaggcacttagaatcagctctgtggcaaaagagttcaatgaaaatcccgtacaacagtttctctttgtaactctctgtcccctctgtttctaataccggtctatgtctatatttcctgaaatatccgggcctgtgattcggtcataagagtctattcagacaaagcaattccttgagtttttccttcttccttcgcttcagtctatgggcaaagctacttgttggcgaagagtgatccgccacaaaaaaccgtatcagggcaaaaacagaagcgcgagctgctgattccattcgaagcttttatcaagccaagcccggcgttgcccttgctattgggaaatacgtactacgagatgaagcggagacgatgacaacggaaaaatcaatccgccgaaaaagtgtagcaggcatcatctcacagccgatcggtttacgtgccggaatttttgtgtttgcagtttggaaaaacgtggtgcgtaaactttttcgctttggcgcgagaagtaaaaaaatctcgaaccaaaacgaaaaaattccggcaccaccttcttcagaaaagacgcgccgcaatcagaggattttcggctcgtatcggtgggatagtggttgatggatattgactcgatagtagagctgtcctccaacggcagccctaagaaaaactcgataaaaaaagcactattctcattgccggacatcgaagagatcgtcaaggacgaaccgaatgaaaaccaatgagatctcatcgccctcttcgacgaaataaccgatcgttccatccgccagcagagtcatatccgagtaggcactcgatcctgaattgacaacaacgggagcggaccagcggccggagacatgatcgaagagatagacagctccatcgcgacgcccatccgggccgagaggcagggagtgcagcacttgatcccttccgttccttttcacttgaagcatagctccattacagccggggtcatggatgccctcgaactgcttggctctcttccaagtaaggccatcgtcggaggagagagcgaagaaacgctgtcggctctcctgccgtccctgattgcgtatgctcatcagtaccctgccatcgggcatcaatgaaagctttgcctcatcgccacggcggtatgcacagtcggaaagctgccatgtatcgccctcatcgtcgctatagaggacatagttgttcaggacgtactcctgccctgattcgcggatggcagccacaaacgtgatacgaccggatggcagcacaagcccttgtcccgaagcacaaaaggaggccaaccagcgactgcgtcccggatcggcacaatccttgccgaagatgaaatgggttatatcccgaggaggcgaccaagtcagtccttcgtcccgactttccgatatataagtgcgctgaggacgatcgggggtagactgccacaggcctactccaccgacaaagatcatcaggagctttcctgcttgggtttgcaccagggctacatcgccaaagccatgattgcgcccctctccctgtacgataatcctgggatcgctccacgatttccctccgtccgtactgcgccgcatgactatatctatatcctccggcagatccgtctgattatattttcgtctgtcggccatcgctatgagtgttccattagccgttttcaaaatggccgggatacgatagttccgcgatccgccatcaccgggtacaaagagggcctcataccccctatacagacgacgggaggcaggcgacagctctttcaacggcaaagggcggccatcgacagccacctcttccacacgggcagtcagcgtatcggatcgggaaaaagaagcaacaggccctatatccgcagccaaataaaagaagcggcgtccggctaccgaatccgcagaaagggctgtggtacgatcttcctttgagatcgggaagctatcg

SEQ ID NO: 878 - DNA (genomic), 836 bp, PORYPHYROMONAS GINGIVALIS; double-stranded, circular
  misc_feature 1...836
  hypothetical: NO
  anti-sense: UNKNOWN
ggagagcgagcgaaagaactttctttacgaaagagacacggcccgttcgcaactggcgaaacttcagggcgcggtcgagtttcatgagaagaagatcgccgaagccgggaaagaccggacggttttcgaggagcgggtaaagaaaaacgaagacgggacataccaaaacccgatacggatcgatggagtggaagacggcagggatatcaaaacaatcgctcgcaggctgaaagagtacgaagagaaagcccggacaggcggagagcacatgccgatcggcgaattatacggctttcaattatccgtcaagagcgaagcctccatgaaagagagtttcgacttcgtggataaccggttctttgtgaaaggttgtggcagcatctattatacttacaacaacggacatttggctgaagaccccaaactggcctgcatgaactttctgaatgccttggagaagattcccagagtcgtcgagagtcatcggaaagaactggctgcgacacaagccaagataccgacgttcgaaacgatggtttctgccgtatggaagaaagaggaggaattgcaggagctgaagagacaggccgcggagctggatcgcaagatcgccctttcgctcaaaaaagaggacaacagcgaagtgaaaccggaagaaacggtcgctcccgatgcgacaatcgcatcgatgcgcccttacgggaggagctaaaaagggaacggtcttccgagcggaatcataccgattggaaagaaatacgggaggatgaaaaaatcaaaccctgcataaagcctggaaggtggtgagagatacagagatatacctgatactttct

SEQ ID NO: 879 - DNA (genomic), 601 bp, PORYPHYROMONAS GINGIVALIS; double-stranded, circular
  misc_feature 1...601
  hypothetical: NO
  anti-sense: UNKNOWN
atgcgattggtcttttcgcatagcttctcaaaaaccttggctgaccgtatctgcgatccaatatggaagtgcaatcctctccataccagcgatccggactgtaaaaggtggggcatcagtgcaagtgcatcttcgggcaaaagaccgaatttgttttctgccaatcctgtcgttatatggctgtgcgtatgcgcatcgacctcaggattgagccgaagcaatatcggagcgatgtcgttcttcgatccggccaatcgttcgatgttcagcaattcgggcacactctctactacgaaagcacctatccgcgcctctaaagaaagcaaaatctcttcatcgcttttgcctactccggcaaaaaaaatatcggaagcgggaaagcctgcctcgatagccgcttcgatctcccctccactcacacagtccgccccgaagccggcagctgcaaccgtctgcaaaatacgaggatgattgttcgccttgagcgcatagtgaatggcaacatcgtgccttcctgcactccgggcgagcgcggaaagcgtcctctccaagagtgtcagatcataaaaatagaaaggtgttttcattgaaaaaataagaa

SEQ ID NO: 880 - DNA (genomic), 746 bp, PORYPHYROMONAS GINGIVALIS; double-stranded, circular
  misc_feature 1...746
  hypothetical: NO
  anti-sense: UNKNOWN
cccgccgtatttgcctcgaacgggatgaggagacagcgtagactactggccaagaagtatgcaaaaaaagaaaataagagcagagtatggaacagaaaatgattttcatcacctataatcaggcctaccacgatattatcattcgattgctcagccgatacaacctcagaggatatacctattgggagactgtccgcggttgcggtagcgatacgggtgagcctcacttgggcactcatgcatggcctacgctcaatggcgccctcatggtcgtttgtccttccgagaaaatgaaaaccataatggacgctctgcgtatccttgacgccgctactccggatcagggacttcgcgcctttgtttggaatatcgagcaaacaatctgatcggagactctcgagctccatcttcttagtatatgggggctgcatccaataagttttgggtgcagtccttttttattgtctcgccgtgtccccccctcatctcgcattcggctgatttacgctctggaattttctcgtttactgtcccacaaaacgtggtgtgagaacttttctcttttggtctgggaagcaaaaaattctcgcgccacaacgaaaaagttctcgcgccacttttttcagagatattgctgtccggtaaaatttcttcagctactcaccattcgtaagcatttgcaagcccattaccgaccgatggcgttggctgtgaagaaagtctggcgtatggctgatagagcgaca

SEQ ID NO: 881 - DNA (genomic), 2402 bp, PORYPHYROMONAS GINGIVALIS; double-stranded, circular
  misc_feature 1...2402
  hypothetical: NO
  anti-sense: UNKNOWN
gagcccaatcaattcacctcggtacccggcgagactattcgcgatttggggctggaaggacaactcagcaaaaaaggaacgcccacgatgggaggtctgatcattatcatctccattctgatccccactctattgttggcccgtcttgataatgtatatatcctgctcatgatcgtcaccactgtcttgctcggctcattaggctttttggatgactacatcaaggttttccgtaagaagaaagagggcttgcacggacgttacaaaataatcggacaggttggacttggcttcatcatcggtatagtactgtatatgaatcctgcggtcgtgatcaaagaaaatagcgaagtgcttcgggatggacaggtcgaacgtgtacacttcaacaaacaggaggtaaaatcgactaagacaacgatcccctttgtcaagaacaataatttcgactacgccgatatacttccgctcgaaggcaaaacaaaagtgctattcggctggattctcttcgtctgcgtagctgtagtggtagtcacctttatatccaactgtgccaatctgactgatgggttggatggtttagcgacggggtcttctgctattatcggagttgtactggctatttttgcctatgtctcctcccatatcgagatggcctcatatctgaatatcatgtttattcccggagcagaggagctgaccatttttgcttttgctttcgttggtgccacgatcggttttctgtggtacaatgcttatccggcacaggtctttatgggagatacaggaagtctcactttgggaggaatcatcgctgttttcgctctgatcattcgcaaagaaatgctactgcccatcctctgcttcgtatttatcatagagggtctttccgtgatgattcaggtcttctatttcaagctgacgaagcggaggacaggtgaaggtcggcgcattttcaaaatgactcccctccaccaccatttccaaaagcccggtaatgccggcatagatgcatggctacagaagcctatgcaggctattcccgaatcgaaaatcactgttcgcttttggctcgtagggattatcatggctgcaattacaatagcaacactcaagatgcgataacgaataaataacgatctgggaagatggaccgattgaaatatgatatagttgttctcggagcaggagaaagcggagtaggagcagctcttttggctcaagccaaaggtctgcatgtatttgtatccgactacggaaagatagccccgaaatacaaggaagaacttaaccgatatgccataccgtacgaagaaggtaggcacacagaggcgataatcctcgaagcaaaagaaattatcaaaagcccgggtattcccgacactgctcctattattcgacaggctgttgccaaagagataggtatcgtttcggaaatagagttcgccggacgttacaccgatgcatttatggtgtgcatcacgggtagtaatggcaagacaacaacaaccatgtggttgtatcacacgctctgtaaggccggtttggatgtaggtttggcaggcaatgtcggttttagtctggccagacaggtcgcttacgatcctcatccttattatgtaatagagttgagcagttttcaactggacaacatgtacgacttcagggctaatgtggccattctgctcaatattacaccggatcatttagatcgatacgatcaccgattcgagctttatgcagaagcgaaaatgagaatcactcggaatcagcaacccgaggattgcttcatctactgggaggatgatccttttatcagccgatgggtagccgaacatcctcctgtagcccgtcttctaccgttcgcaatggaagctcgaacggataatacaactgcttggatcaatgaaaagaacgaattggttgtcatgaatcttaattcaccttttgttatggatgaggaacttttagctctgtccggcatgcacaacaggcacaatgctatggcaactgccattgctgccaaagctatggatattaagaatgaggctattcgagaagccttgcaggatttcaagaatgtaccgcatcgactggaaaagattgctcgcgtaaagggtgtcgattatatcaatgactccaaagctacgaacgtaaattctacctggtatgctctagagagcatgaaaactagagtaatactcattctcggggggacagacaaaggcaatgactatacagatatagagaatctggtattgtctaaagtcgatggactgatctttttgggcatagataatgagaaactccacaaattcttcgatggcaagatctcgcggattgcagatgcatgctcgatgcatgaagctgtttctttagcatacaagatggcatccagggga

SEQ ID NO: 882 - DNA (genomic), 656 bp, PORYPHYROMONAS GINGIVALIS; double-stranded, circular
  misc_feature 1...656
  hypothetical: NO
  anti-sense: UNKNOWN
agtatgtgtatcaatttgggagtattgtcctatttcaaatacttcaatttcctcggtgagatgcttttctctctcattcaggaaatcggtctcgtgaccaatcgcccggagtggatcatgaccgattgggagcattgggacattatactgcctgtggggatctcgttctatacttttcagacgatgagttacattatcgacatttatcgaggtcaggtgcagcctctaaaacgttggatagattacgtcttctatgtctctttctttccccagctggtagccggccccatcgtccgcgcccgagatttcattccgcagatataccgccgtccggtgttggaagggagggaatatgccgaagccctgatgttgataatgggaggtctcttcaagaaagcgatcatatcggactatatcagcctgaactttgtggatcgcgtgttcgatgctccaacgctttacaccggattggagaaccttatgggggtgtatggctacgccctacagatctattgcgacttttccggttattccgacatggctatcggtatagctctggtgctcggcttccgcttcaatatcaatttcgattcaccttatcagtcggccaatatcaccgagttctggcgcaggtggcatatctctctttcgtcatn

SEQ ID NO: 883 - DNA (genomic), 848 bp, PORYPHYROMONAS GINGIVALIS; double-stranded, circular
  misc_feature 1...848
  hypothetical: NO
  anti-sense: UNKNOWN
atttaccaccttgcccgacacacctttgcgacgatgtcgctcagcaagggtgtaccgatggaaagcgtagtaagatgctcggtcacacgaatattaaactacgcaatatatgctcgtatcaccaccaagaagattgagcatgacatggagcagcttgcgaacaagctcggaaagttcaatacagcgatgggcgtttaatcagattgtacaactataaaatcagacatcattatgaaatctacagaaaagaaagaactgtcccacttccgtttgaagttggaaacttacctcaacgagcattttcccgaaatgtcgggaaacaatccattcattacagcacggtcggatgaagcgctgactgcctactgtgatgccgtggcacaaggcttctctcatcccgaagccgagagtatggcaagcgaagtcctgtatcaagggctgcatttctcccgatacgatacccttgtttccgtcttggagcgggagttcgagcaggaactgccgtcacctcttcccgaaagactcgctccgatactgctaaaaaacaaggcgatacaaagcgtatttgccaagtatgaccttacagacgactttgaggcaagtccggaatacgaacatctctacaccgaactgacaggcacgatagtcctccttatcgaaagcaatcacctgcctacaataggcggagggaacgataccgtataatcacccaacatcggaagcgtttcagtatcaagagccaagatatgtactccgcttcacacgacaagggacaagctcttgtctttgtgtcgcgcactatcttgtccacgctcttgaaactctaaaatgctttgatatggatatac

SEQ ID NO: 884 - DNA (genomic), 400 bp, PORYPHYROMONAS GINGIVALIS; double-stranded, circular
  misc_feature 1...400
  hypothetical: NO
  anti-sense: UNKNOWN
ggcgaagctgcccaacgactcgaaattctattgcgtgcatacaaaagactcgacaaaaagagctaccgcaacgagaccgagctgatgtacaaactcgccgaagaactccgaagcgataagtacaaagcggacgtaacgaaactggctatctccacttgggtagacaagatggacgaagccaacaaagctttcgaccggatattcgacctccacagccggcgaatcgggcgaattgccccaaatcccctccgaaccgtcctcaccgagtggcggatccgataccgatggcagcagtagcggcgagccgggttcgcacagcggcgatctgtagccgttagcacggcagggagggatgtaccaaagccaaaccactctctgcctgcatccaaagagagagggg

SEQ ID NO: 885 - DNA (genomic), 2165 bp, PORYPHYROMONAS GINGIVALIS; double-stranded, circular
  misc_feature 1...2165
  hypothetical: NO
  anti-sense: UNKNOWN
acgacaaggaggtcgaaaggccgcagcgtcttatctgccgactcggcagggacagagccatatttggcttctatcttgttcagcaaggcagccatatcgccacgccccacatggatcacttcatctccggccataaccgtcggaacggaagcgatgcccaacgactccacttcgtccgggaagaaagaaccatcgaccatggtgtgattgatagtcggattgagaatggcaatcatattgagggtctgcaccacatcgggacaattcgtacaagagagggatacataggttttcagctctatcggcccattgatacggcggattctatcctgtactccttcatcggggatattccttccgataccgtcattgttgagaatagcaagaagcagtgagctaaattcatggccacccgggataccacggaagccgatcccgctatccgctccgtctacgagcagatcgatacgaaaatcatctgccgcattgtattccgcacgaacatgatccgaaacggatgcaagcccatcgagcatttccttcgcctcgttgtaggaaggatgagacgtatgagcattgagtcgtaatgtataggactttttcagttgggcaaagtaagaacccacttgggcaagagtatctttatcaagcatagtcgttaggataatgattaaaaaggaccttaatcaagagttccgattatctcactgtattcggagaaacagcatggagaactctttcgtgccttaaagaaagagggtgtgttgtgatcgcctcattttgcgattccgacacaccctctctcctcggtttactgcttagatcttaccaacgagatcaatgctcggtttcagtgtctgctgaccttcacgccacttggccggacatacctgaccatcgtgagcagctacgtattgtgcagccttgatcttacggaggatctcttctgcatcacggcctacgctgttgtcgttcagctctacgattttgataatgccttcggggttaatcacgaaagagccacggtaagccatatgaacatcatcgatcaggatacccagatcgcgagtgagtgcaccggagggatcggccaacatgggatactgtaccttcttgatagcaggagaagcgtcggcccaagccttgtgtacgaagtgggtatcgcaactgcaagagtaaacctctactccaagttgcttgaattcttcatatttattggccaggtcttccaattccgtcgggcatacaaaggtaaagtcaccgggatagaaaacgaccaaagaccacttgcctttcaagtcttcgttggtgattactttgaattcgccattgtgataggcattgagtttgaactcggggaaaacggtgttcaggataggagtcataatgcttttgtttttagtttagtatgaacgtttgtttcaggtgcaaaactatgtgtactatcctccatccacaacagcctcgatatatcagaccattgaccgcatctatataagtgagactgtcgcacggtattttcttggagatttcattgtcaatcgactgatttttagtgcctttatagatataagaaaccttctcttttttcaaaggtctcaaataggctatgaacatggatttgtggacatcgtgttgtgtgaggggagctgatattcctcgtttgaaagatgacaggcagtccccttcgacgaccacccggagaatggaatgaggaaaacgaaaactgcgccttcttataaaacattaagaaggcgcagttttcgtttaaatcttagctctataaatcaaggaaccaagactttaaggaaatacattacaccgtttgccgttatacggacaacatagacaccggggacaagggattcatttttgacaagttgaccagttgcattgaatacttccatcttggaatactcttcctctacaacaattttgccattctgaacatatgctttgacagagggggtagcaacaatttgttctgtagctgtaggctctgctttatcaaggctttcttgcccggcattgataatagaatggttttccgcattggacattggatggtgtacgaaagcaagaacatctgtatctttaatttcaaagccatccaacttaaattctttcttgatggtaaaacttccatcggctgcaatatttaaagc

SEQ ID NO: 886 - DNA (genomic), 611 bp, PORYPHYROMONAS GINGIVALIS; double-stranded, circular
  misc_feature 1...611
  hypothetical: NO
  anti-sense: UNKNOWN
aagctactttacgatcgatttgctgaacgatggagactttcatcttcgatttgttggcgagtgtacgtacacgcatatcctccggacgttcgatctcgttttcctctacgtgacgacggatcagatcgaggaattctttcccatagcgagtagccttgccgacacccacgccgggaatattctgcagctcttcgatcgtaacgggatagaacgtagccatagcctccaatgagggatcttggaagataacgtagggaggcaacttgagagatgcacccaatttctttctgaggtctttcatcatggcgaacaggaccggatccatggccccaccggaacctcgccctcccaccttaggagcatcgtcatcctcgtcctcttcgttctcatcgacgatcttgaaagaaacaggtttgagggcaaacttcttgcctttggctgtcactttcagcagaccataattttcgatgtcccgactcaaatagccggaaagcagtgcttgtctgatgacggctgtccatgttgtctcggtttcatcgcttccgataccgaagacctctaaatcctgatgtccgaatgactctatatcaggagtcaattcgcccatcaat

SEQ ID NO: 887 - DNA (genomic), 2174 bp, PORYPHYROMONAS GINGIVALIS; double-stranded, circular
  misc_feature 1...2174
  hypothetical: NO
  anti-sense: UNKNOWN
tcagctcggtacccggccgatagaaagtttttgccaaccattcccgtttcttctcgagatagcatttgtagaagtcttccgtataccgatgagctgtctccatggtcgcggaaaggaacggatgtccggaagaggggtcaagaaggtgcagttctgccacgatagccctgaattggcggcgattctcttctccggcatattgtgccagagagcgttgcatctcattgtagtaagcggaggtgatcagcttcttcgtctcttcgcttatgatcatgcggacgatgtcctgagagaggaaggtagccatttcaccgacgagaggtatggcacgagctttcccatcgccatccttccgaaacttccgcaggcgtagtcggcagtcttcattgagctgcttgacataagtacgaagcttgactgaatggcttgcaggcctgatattcatccattcatccagaagacgtgagggcagttgtctctgattcatatcgaatgccgacagcagttggctattgagcttgtctttcctcccctttatctcctgcttgtatttctccaaagtcgtttcagccttttccctccggtctttgctcttcggattctgtggagggataaatcggtggcgcatctcagggaataatgccgaaaactgtagttttccctctgccgtttcatccaggatccgattcgcttttctgaggaaatcactctgcatacggctgaagctcccctcacacagcaactccatcaagagaagcttacgaaggttgtgcacactgataaatcccatcgactgaggattgctcaaggccctcttctcccctgtcttactcttaggatatacagggtcggatgtatggcaatagcctatcttattgtcgtatatggcatagcggggagcaaagagagagaagcgtacgggataagacgcctctccactgatcatcctacttacctcttcttcattctggaagtctgacagcttgccgaatgccaaggcatgatccgttatcgtgcgatcgtactcaccattccggcctacctttttggagtaagaatccagctcgatttcacccaaatcgacacgaaagcgtatacccttgagcagatccatctcctcgataaaacgaagcatcagataggggaagcgatcctgatggcggatcctcttggtcagtgcctctgcccaatccgaagagccgtcccaaagcaatcgactctcttcgttcaggctgttttccgagaggttgttcatgctattttcgtccagcgcagggaggaactgcgcccgctcctcttcggggagcatatcgtaaaggatgcgggggcaacggttcagttcgttgagcatatcgagcaagagagcttctttcgtattgctgctttcgagcctgtcgtgaggatgacggatgcagagatcgcagaaggtctcgtgcacggctcgtgcccaattctcatcggttcgtttgaatccgcgaatcctgctcagcataccggaagcctgctccctatcgaggaagaggcaaatgaaaaaggcaaggccactaacggtcaggcattcttttccgtccgctacgcttatcaattgttccttcctgttctttgccaggacaaagtcgtcgggcttgaagaaatctgcaaaccgcgattgtgctctcccgcatgccaaggagtatgtcccggtaataaaggagctgatgtcagggctgacttcgagatgctcgaatgtagtgccatcaagccgattgtgcgagaagtcattgcgcaggaaatcaagtaaagaataaagctctctgatcagcctttgggccgaatcgggatccacaccggtcttgctatcatggtctttttcgatctgactatccggatcgaaataatggaggaaaggcagatagcgtctgctatggccatagactttggtccagcgatcgacggagagcaggtgatcacaaagaagagattgcttgagcgactcttcattcaatttcttcttcccgaacttaatgcgaacatgactttcgacttctatcaaattctctcgtgcgaggttgagataaagtccgaagtactgcggatcgtcttccactgtacgggattgacctttgttttcagaagcaggaactgtattcataggtttgagttttcttgttctatcagcgatatataaaatgtcg

SEQ ID NO: 888 - DNA (genomic), 484 bp, PORYPHYROMONAS GINGIVALIS; double-stranded, circular
  misc_feature 1...484
  hypothetical: NO
  anti-sense: UNKNOWN
atttattccgaagtaaggacggaacaagtaaccgttcaagaagaacagacagagtaaagcggtcggcagatttgtccaccgctactttctttcatgagcaggggaaatggcgaaaaagaaaggagcaaagaaatccgataaaaagcatttcgttatttttggcagtgagcagatattctttgtggaaaatccccctaaaatctatgccccatatagcaatttacagtagctttctgaacttcatctccgccaacctgttgatttcatccttgtaggtctcaagatggtggaggatgatgttttccacatagatgccgatggtcatatccctattcctcatagacatgactatctccgccaatgtatcctgtaactctttggcaatatagatggtcttgcgatttttcaaagtattgcgacagatgaaaagcgactcataatcgcctttgtcggattttcgcctttctcttcttgaaactctnga

SEQ ID NO: 889 - DNA (genomic), 2295 bp, PORYPHYROMONAS GINGIVALIS; double-stranded, circular
  misc_feature 1...2295
  hypothetical: NO
  anti-sense: UNKNOWN
ttttaattccccttggtacccggcgcgagaaataaaaaatttacgcgccgaaacgaaaaaactgtggttccactttttcaggaaactcagaccgcaattacagattttttgggacgtatttccgaggtgacgatagatcgaactcgcgctactacagcatatacctcctatctttgccgagaaaaaggagaatacccgatccgaaaggcgatagaaccatagggatataaatgaggatattctccatcacaacggcatcaggctaatatgacaaaggcttacggggctggctgcccctttcaaatgaaggcagaggaaacgatcaggcgaatggatgaatccggccggtgcggacgatcatttctgtttgccatagactttgagatggatgaggggatcttcatatcggaaccgctgaatcaaaaagaaatcctattcgacgtacgaggacaagggaatgcacccacagctaccgatacgaatgagagcaaggctcccgtgacttttatcccccaccccgaatcattggagacctatcgacatcgtttcgatcggatccgcacagccctgatgcgtggcgatagcttcttggccaatctcaccattgctacgcccattgagatgaatatctcgcttgaggaggtattcagtcgcagtcgcgcctcatacaagctcttgattcccggacgactggtttgtttcagtccggaacgatttgtcaaaatagagaatgggcaaatttccaccaacccgatgaaagggaccatagatgcttccctgccggatgccgccggccgtctactgtccgactataaagaaacggccgaacatcgcaccatcgtagatctgttacgcaacgacctgaaccgagtcagtcaccacgtacgcgtctctcgctttcgctatctggatgaactccacacgaacaagggacgactgctgcaaatgagttcggagatcacaggcacactccctgcggaaaaagaaaagcgtttcggctccattattcaagagctactacccgccggctccatcagcggagcacccaaagaggccactatcgaagctatacgggaggcagaggggcagcaacgaggcttctacacaggtgttttcggttatttcgacggtagcagcttcgattcggctgtaatgattcgctacatcgaacagcttcccgatggccattacctttttcgcagtggcggcggcattaccatcaacagccgctgtgacgacgaataccgcgaaacacaacaaaaggtatatctgccattctgatcgaatatgtgctatatcgaaaccatccgcatcgaagacggcctgccctatctgcttgcgctccatcaggaacgaatgagccgcacgtgcgacgaaaagggctttcccctcccggaaataccttgcctgacgaatctatgccctccggaattgatgtgcggaatgaccaaatgtcgtattctatatggtaaggagggcatttcggacgtttccttttcaccttatacaccacgccaaatatcctccctgcgtatcgtaacggctccagccgatttggactatcatttgaagcaggttgaccgttcgtctctcgaagctcttctcaagcaaaaaggagaagccgatgaaattattatcctgcgcaacggactcctgacagacacatcctacaccaacctccttctacatatcggaggagaacttctcacaccgcgcgtccctctcttagaaggcgtacaacgccggtatctgctccaatccggtcaaatacgaccggcagacctgcaaatcgaagacctcaaaaaagcagaagaaatactgctgatcaatgccatgctccccttggggcataccattcgtatacacccatcgcagattattttttgattatcatcttcggctatcggatcgagttatccgacagaaggcttagaagaggtaggagatattgcagatagccccgatggtatggccggacgttcgttcggcttgcggatcggacaggatatgtgagatgacaccgggcgttttgccataggctataccgtcctttcttttcatcaggtcgccatacaaccgcagctctgtcatcaggcggtgggtattctgcatcggaatcgagacgtacagagaggaacgcacctccacgccttctctattacgataggcatagggcaaataggccagctgatagtcgagctgctctttctggatggtacgaaatcttatacgaatgcgtcagcaccattcgattaagcagccgaaagcgaaagtccaaaatccaatttggatccg

SEQ ID NO: 890 - DNA (genomic), 3175 bp, PORYPHYROMONAS GINGIVALIS; double-stranded, circular
  misc_feature 1...3175
  hypothetical: NO
  anti-sense: UNKNOWN
ctcggtacccgcgatttggtagacatcgatacctctatcgccatgacttatatgatgctggaagcacatagtctgggacttggatgtacgtgggtctgtgctttcgatcaagctctttgttcggagatcttcgacatcccttcgcacatgacacctgtttccatattggctctcggctatggcgatccgaccgtacctccgcgtgaggctttcaatcgcaaaaccattgaagaggtagtcagcttcgagaaattatgaaacgttggtcaggtttagcggccgttccggggatgatcattctcggtgcggcctttttttcttgccggaaagcacctgcctatacggtattgcagggggagatattccatacctattatcatatcaaatataagggagaggcagatcattcgcagcgagtggatagcgtattcagagctttcaatcattcccttaatccgttcgacagtaccagtatcattgccggagtgaatcggaatcttccggtcaggactgacagtatgttccgccgggtatttcgtcgggcgcaggagattgcagccgtttccggcggctcttacgatattacttgctctccgctgatcaatgcttggggtttcggtttcgaacataaagaggacgtgactgcacagttgatcgacagcatcagggcctttgtcggttaccggagggtacgattggatggcgagacggttgttaaggatgatccgcgcactacgctgaacacctcttccatcgccaaaggatatgcttcggatctggtgggcgaagccttggctgctcatgggatcggggactatatggtagagatcggtggagaggttgctttcaatggcctcaatcctcaaggcaagccttggcgcataggtgtaagtaaaccgcaggatgacagtctgggcttggcgatgcaggagttcgaactcgtcgtagagcttagtgggaaagggggcttggcgacatcgggcaactaccggaatttctatgttcgggatgggaagaagtatgcacatacgatcgatccgcttagcggctatcctgtgcagacggatgtgctgagtgccacagtcattgctcccgattgtatgacggctgatgccttggctactacttttatggtggtcggttcggagcgtgtgcctgctattgccgccgaattccccggtgtggactatatgcttattttgtccgatggagacggttcttataagactgtgatgaacgaaggcttccggaaacgagtagccaagtaatcgagcctcgtctgtaatcctccaagcctctgtctttttctcttcggatcggtacaatcttttagaacgggatcgcatctgtcgtaactgaacgaaaaagatttggcagatagttcgggaagattttccatacggctaagtcacaataaaaaacaagagagggtatgcaccgcgatgggcataccctctctctatttattgttctttactcgttaggcgataccgctgaagcccatgaaagccatagccaatataccggcagccaagagtgccgaaggtattcccttcatagctttggggagattggtcatatcgagttgctctcgaatacctgcgaaagtaaccattgccaaggtgaaaccgatagccgtggatattgcatagacgaagctctggagcagggtataatccttctggataaccaaaatagccacaccgagcacacagcagttcgtcgtaatcaagggcaagaatacacccagtgcctgatagaggggaggagatactttcttgagtatgatctccaccatctgcaccaaggcggcaatgaccaaaataaatgcaatggtctgcataaagcccaatccgaaacgatccaaaacgaacttctgaatcaggaaggtaaccaaggtagccagtgccaatacgaatgtcacggctgcacccataccgattgaggtgtctaccttcttcgatacgcctaagaatgggcatataccgaggaactgcgacagcacgacgttattaacgaaaaccgccgctatgaataacatgaaaaattccataatgatgccaattacttaagtgagttatgcttttttcttcattttgttcaccaaggcaatcaggtagcccaaagcgatgaaagctccgggtgccaatacgaagatcaatgctccataggattcattgaaaactgcaaagtcgaaaagcttaccgctacccaaaagctcacggacaataccgagaacagtcaaactgagggtaaagcccaatccgataccgataccgtcgaacatggagtgtagcagaccttttttcgatgcaacggcttcagcacgaccgagtacgatacagttcaccacgatcagtgggatgaagataccgagactcttgtccaaatccggcatataagccttgataagcatctgcaatatcgtcacgaaacctgcaatgatgacaataaaagccgggatacgaaccatatcggggatgagattcttgaccaaggatactaccatgttggagcagatcaatacaaacatggtggccagtcccatactcataccgttgatggccgacgttgtcgtggccaacgtaggacacataccgaggaggaggacgaatgtcgggttctccttgataatgccgtttataataacactcaaattcttactcattggcgcttcggtattatctgtgttagtatttatcgtagaatcagccggagctgcctcgacagactcctgagcctgtccggcactgccttgagcggctttgaaacctctgtaggcacgatccattgcatccaaaaaggctcggctactgatcgtcgcggctgtgatagcatccacttgaccgccgtctttggaaacagtcagaggagtatcactcatctgtacaccacgtacatcttggatcagtccttcttttttggccggcgttcggaaccactcttgcatcttggctcccagaccgggtgtttcgctgtggctgagcacggagaagtcgtggattttgccatccatatcgaatccgtacatcacagtgaacttaccgctaaagcccttgtctgtatagctttctacagcgtaacccactatttcctgaccttttttggccgggaatacggtgagcttggctccatctacatcaacttcgaatctctcttcgtacggattgttgtc

SEQ ID NO: 891 - DNA (genomic), 877 bp, PORYPHYROMONAS GINGIVALIS; double-stranded, circular
  misc_feature 1...877
  hypothetical: NO
  anti-sense: UNKNOWN
ccctgttcgccgtaatatactgttttaattcctgtatggtgcaattgaaatctgcaaactcgtacctatccactgcaggcttggcttcgttttaattcctgtatggtgcaattgaaatagctataaccctcgatgagtactacgagggaaatggcgttttaattcctgtatggtgcaattgaaatgaagtagttctcgctcgctaccgagaacgcttcttcgttttaattcctgtatggtgcaattgaaatttttcagtcggtagcgaaaactactttttatttcgttttaattcctgtatggtgcaattgaaataacgcattttatgtgcgccaagataattggggcatgttttaattcctgtatggtgcaattgaaatttacggcaaaagggtttagatacctaatggaaaaatcgttttaattcctgtatggtgcaattgaaatcatttttacaatggatgccgaaaccgacagtctaagttttaattcctgtatggtgcaattgaaataagaaagaagaaagaataagtagaaataaagatgatgttttaattcctgtatggtgcaattgaaattaatgttacacaatggtatactgatgatggtaaacttgttttaattcctgtatggtgcaattgaaatttacgaatatctaacgatgatactatagtgcagttttgttttaattcctgtatggtgcaattgaaattaaatcaatcagacagtatcaaatgaagtgcggatacgttttaattcctgtatggtgcaattgaaatctataaaagaaattccaagagagcatgattctgaggttttaattcctgtatggtgcaattgaaattagcagacgaagacgattttttcaatgtagtaa

SEQ ID NO: 892 - DNA (genomic), 937 bp, PORYPHYROMONAS GINGIVALIS; double-stranded, circular
  misc_feature 1...937
  hypothetical: NO
  anti-sense: UNKNOWN
atatggagaagaatgcactcagctcaaagtcggaaagggcattctctacaggccggaagtcgaaaagggtagtagcccatgcaccgaggtggaagtccatcatgctgttgagttcggcatgtttgaagtattggatcaggctgaagagcagcaaaacgaatcctccgccaagcccgaaaattcgtcgtgccatcagcgggttgatgatggcatcgtcctgccggcggggttgctccttcatcacacccttgtcgggagggagcgaagccaaggacaaggcggcgaaagtgtccatgatgagattgacccacagcatttgcgtcacggtaaggggcgactccgtacccacaaatgcgccgatcagaacgatgatacaggccacgacgttgatggtcatctgaaagaggataaaacggcggatattccgataaagcgatcgtccccacataacggctttggcaatgctgctgaaagaattgtccagaatggtgatgtcgctcgcctctttggctacggcagtgccatcgcccatcgagaggcccacctgtgcgcggttgagtgcaggagcgtcgttcgtgccgtcgcccgtcacggccaccacttcgtgagcttcctgcagcaggcgtacaagcctttccttgtccatcggacgagcgcgggacatgatacgcagttcgcctatccgagggcgcagttcctcgtcggttagggctgcgaaatccgacccggtgatcatattccgctccgtacagctttcgtcccacagccctatttggcgaccgatctcccgggcggtacccggtgtatcgcccgttacgattttcacctgaatgccggccttcatacagtcgctgatcgcttcgggaacgtcggagcgaaatggatcggctatgccgactatcccatgaagcggaggtcatgcacgtggagacgccat

SEQ ID NO: 893 - DNA (genomic), 3468 bp, PORYPHYROMONAS GINGIVALIS; double-stranded, circular
  misc_feature 1...3468
  hypothetical: NO
  anti-sense: UNKNOWN
agatcaaggggcgcatcatcggccgagagggtcgcaacatccgtgcattggaggctgctgccggtatagagatcattgtagacgatacgccggaagcgatcgtcttatcgggattcgatccggtgcgtcgtgagatagcgcgtctggcactgcatcagttggtacaggatggacgtatccacccggcacgcatagaagaggtggtatccaaagtaagaaaacaggtggaagaagagatcatcgagacgggcaaacggacggtgatcgaccttggaatccacggtctgcatccggaactgatccgtctgatcggtaagatgaagtatcgctcttcctatgggcagaatctcttgcagcattcgcgtgagacagctaacctctgtgccataatggccagcgaattggggctgaatccgaaaaaagccaaacgcgccggtctgctgcacgacatcggcaaggtgcccgacgatgagccggaattgccacacgctctcttaggcatgaagctctgtgagaagttcaaagagaaacccgacatatgcaacgccgtgggagcgcaccacgatgaggtggaaatgatgtccctcatagctcctatcgtacaggtgtgcgacgccattagcggcgcgcgtccgggagcacgccgtgagatcgtggaagcctatatcaagcgtctgaatgatctggagcaactcgccatgtcctatccgggcgttatcaagacctatgctattcaggccggccgcgaactccgtgtgatcgtcggtgccgacaagacggacgatgcctcggtggaaacgctctcgaacgaaatagccaaaagaatccaggacgagatgacctaccccggacaagtgaagatcacagtgatccgcgaatctcgctccgtcagctacgccaaataatcccgcacaccggtggatagtacctgctcgcatgatgtggcggttatgatttatacctcctcctatcagcagcactagaggactacgccggacaaagcaaaagacggatggactaccgattagacaatacgacgacctccctgacgaaggatgcctgcaaggggtgtcatagccagccgctcagcacttatgactggctgaatgacatccccgatttgcccgaagatggcggattcgtggaggtacagttcaagaatacgcgcaaaggatactacctcaacagcgagaggatagagctgcacaaaggggatgtagtagccgtagaggccaatccgggtcacgacatcgggacagtgacgctgaccggcaagttggtaaaactccagatgcgtaagcatcgatacaatacgaacaacggcgagcctttcaaaatataccgcatagccaaacagggcgatctggataagtactgcgaagcaaaggcgcgagagtacgatacgatgattcagtcccgtcagatttctgccgagctgaatctggacatgaagatcggagatgtggagtatcagggcgatggcaataaggccattttctactatatcgccgatgagcgcgtggactttcgccaactgatccgagtattggcagagaccttccatatccgcgtggagatgaagcagatcggtgcaaggcaggaggccggccgtataggcggtatcggtccttgtggccgccagctgtgctgctcggcctggaagatgaatttcgtatcggtgaatacgagtgcagcccgctatcaagacttagctctcaatcctcagaagctcacgggcctctgcgccaagctcaaatgctgcctcaattatgaggtggatgcttatgtggaagctcgtaagaagatgccgagtccggagatcgtcttggagacgaaagaaagtgcgtaccactatttcaaggcggatgtattccgtcgggaggtttcgtattctaccgttcccaatgctccggtcaatcttacgactatatcggctcgtcgtgctttcgaggtgatcagccagaacaagcaggggttcaagccggtatcgctggagtatgacgacaagaagcagtcgtccggacacgaattgtccgacattcttacggataacagcctgacacggttcgacgatgccttgtctcgtcgcagaagacgaaacggcaatggcaatagggacttctccgacagggaaaaagctggcgaaccgcatcgtacacctgattctatacagcctacgcctcgcgttcgcagcagtagcaggatgccatcgcgagagaaatctccccgaccggagggaggtgatcgtcgtgagaatatgcgagagcgtagtcgaggcgatgctcgttttgcacgtccctatacgaatgagggaggctccgaacgtatggaaggagccagacgtgtggtgggcagtggccgcagaccaccgcgtcaaagcactccacgtcaggaagaccgacaaggagagagaaaggaggaataaaggggagatgggtgctgccgtacgaaagcaagtccgaggcgcaatcagtttttttctggttgcattggggatatgcttggctgtgtcttgcacataccgtaaggacgagcgaatactgtatcgtcaggtgcctcatggaaggtggcagaagcgcgatgtgctcgactacgaaatcctcataccggactatactcgctcatattctttggagctgctgatccgccatgacaatcggtatgaatatcgcgatttggcattggcatacgaggtttcagtgggagagcgtctgatctttgcggactctgtggatctgactttggccgacaagccgcaacagtggaacggaaaaggggttgccaagcagcaaaaccggtttcgcctgccgatctccgcacgttttccctattcgggtctttataagatagagttaaagcacaatatgagggtaccgactctttcaggtatcacggaagtaggtattcgtttgacagaagggcgagacagtcctccaccctctatcttaccccaacgagaatgatcatagaagaactccatatcgtcaattttaagagtatcgcagctgccgattgccggttttcgcccaaagtgaactgtctggtggggaacaatggaatgggcaagactaatctgctggatgcgctgcatttcctctctttctgtcgcagtcatctttccgtaccggacaatatggttgtcagacatggagaagaaatggccctgttgcaggggctttatcgggatgaaagcggcgatgggatagagctgctcctttctattcgtccggggaagcacaaggtactgcgtcggaataagaaagaatatgaacgactgagcgatcatatcggtcgcttcccgctggtaatagtttctccgcaggactatcagctcatactgggcggtagcgatgagcgcagacgattcatggatcagcagctttgccagcaggatcctcggtatctgtcggctctcattcagtacaatcggcatttgcaacagcgcaatacatgctcaagcaggaccgt

SEQ ID NO: 894 - DNA (genomic), 2073 bp, PORYPHYROMONAS GINGIVALIS; double-stranded, circular
  misc_feature 1...2073
  hypothetical: NO
  anti-sense: UNKNOWN
cgaggttgatttttgcattgggaaaaacgatcatggctcaactatttgagatcgattattcgtcatgcaaaggcatagcgcaggatgaaaagaacagccagaatgtaaagaggcagggatatactgcggtattgtccggacaagagtttgacaaagacgaatgccaacatccccaaggccattccctctgcgatagagtaggtgagtaccattgtcagcagtgtgatgaagacgggaaaagtctcggacaggtcggacaaatcgatcatcgaaatggatccgagcataaatacccctaccattacaagagcacctgtcgtagctgcacctgggacaaggagaaacaggggcgacagaaaaagagccaacaggaaaaagctgcccgtaaccaatgccgtcaaacccgttcgtcctccttcggcaatgcccgatccgctctccacataagtagttaccgtggaggtgcccagtatggcaccgaggcttgtaccgatggcatcggccatcatggcctgcttgatattcttgacattccctttttcgtccatcatttcagtcttggcagctgctccgatcagtgtgccgatcgtattgaaaatatccatgaagacgagagcgaatatcgtcatagccatatcgaacgaaaggagaggggcgaaatccatttgcaggaaagtgggacttaggctctgcggagaggagataggggcaaatccttcgggaatggctgtcactcccagcggaatgccgacgatcgtacaaatggcgatactgtagaacaaagcccctcgcaccttgcgcacgaccagtgccgcgctgaggatgataccgaggatggccagcaagaatatcggagtgaaaggcccgagagcgaccaatgtagccggatgggatacgataataccggcgttcttcagtccgatgaaagcgataaacatgccgataccggccgagatagcatagcgcagattgtaaggaatgcaatcgacgatcttctcacggatattgaatgccgtcagcaggatgaagacgatcccctccacaaagacggcagccagtgcagtctgccaagagtagcccatgccttgaaccagagtgaaggcgaagaaagcgttgatccccatgctcggagcttgagcgaagggcagcttggccaaaaatgcaatcagcagcgtagccacggccgaagaaagtgccgtggccgtgaatacggctcctttgtccatccctgctgcagcaagaatatcagggttgaccgccaagatgtaactcatggtcaggaaagtggtcacccctgcaataaactccgttcggacggagtgcttctcgggattgaatccgagaatggattgccaagttttcattttttactgaagagtttcgttcagttgaaagtccatttgaccgcaagagtagggatgcaggagaatttgtccatgcgagcgaagttcctgctgatttccatctctgtccctatgctgagattgaaatccttgtcgatgcctttgatgcgattgaggttgatccagaactgcggttcggacaggaatacgaacttatccccttctttgagcacagggcccccgattgggttctcttgggggaaaccccaaagatcgaggaagccgttgaaggtaagcagaccgtccagaaaggtgcatgtaccaagtgccggtgatctgataggtgtggaagtcgtgcgcacccagatgcttgtacatgggcgtgatcgtaaatccacgtgtaaaggaggggttgttgtaggtgtaggtggcaccgattagagcatcgtgtccgaaagtaaagcttgtggagaggcctccgttgtactccaaatgaatggaaacgggagcttgccaaaacttcagttcgcgcgaaatctcccaataggccgactggatacccttgcccgtgtaatccatgtcgatgaagaagaaggtgcttccccatttgtcgggtgtgaagttttccactgtggtagtcagtttgggacgtccatctagttcgtcgtagatggaatgaccgaaatcgtagtgcaactgcacgttttgtgcgttggcacataggccgagg

SEQ ID NO: 895 - DNA (genomic), 2416 bp, PORYPHYROMONAS GINGIVALIS; double-stranded, circular
  misc_feature 1...2416
  hypothetical: NO
  anti-sense: UNKNOWN
ggtcaaagagtttgaaaggatctgattctgagcgatagcccaagagatttcatggtcttctgtcctaatctgcatcaatgtatgctcgaatgcgagtgtcctctcttggagtatctgtgccggatttgttcgttgcaatgtattgagaggaccgtgcgttaagtgcaaaatgaaggctgtgcggtgagggagaaccctctgcacagccttcggcttgtaatgtgatatgaatgtcctacaggatatttttttcgaaaggaatcaaaaacgcatcctgttcgcaccgatgtttacatcatgccgcccattcctcccatacctccgggcatggccggtgcggcaggattatcttctttcttgtcagcgataacgcactccgtagtcaggaacatacctgcgatagacgctgcattttccaatgctacacgtgttactttggccgggtcgataacaccggtagtgtagaggttttcgaaaacatccgtacgggcattgtagccgaagtcgtccttgccttctttcaccttctgtaccacaacggcaccctctttaccggcgttcgctacgatctgacgaagcggctcctcgatggcgcgtttcacgatctcgatacctgtggtttcgtcttcgttctcacccttgagaccttccaaagcagctatggcacgaatgtatgccgtaccgccaccgggtactgtaccctcttcgattgcagcacgcgttgcactcaaggcatcttctacgcgatccttcttttccttcatttccacttcgctggcagcacccacgtaaagaacagctacaccgccggcgagcttggccaaacgttcttgcagcttttcgcggtcgtagtcgctggtcgtattctcgatctgagctttgatctgcgtgatacgtgaagcgatgccttctttgtttccggctccgttaacgatagtagtattgtccttatcaaccgttactttctcagctgtaccgagcatatccatcgtagcattttcgagcttcagaccggtctcttcgctgataaccgttccgcccgtcaggatagcaatgtcttcgagcatagccttgcgacgatcgccgaatccgggagccttcactgcacagatcttgaggctgccgcgcagacggtttacaaccaaggtggcgagtgcttcgctgtcgatgtcttctgcaatgatgaggaggggcttgcccgtctgaaccgtttgttcgaggatcgggagcatctctttcaggacggatattttcttgtcgtagatgaggatgaaaggattttccatttgcacctccatcttatccgtgttcgttacgaagtagggagagatgtagccgcggtcgaactgcataccttccaccacttctaccgtagtgtcggttcccttggcttcttctaccgtgataacgccttctttcttcaccttgcgcatggcttcggcaatgaggctaccgatgttttcgtctccgttggcagagatcttggctacgtgctcgatcttctggaagtcgtcgcccacttccttagccatacctgcaatgtgagttaccacagcctttacagccttgtcgataccacgcttcaaatccatcggattggctcctgccgtaacgttcttcagacccacgccgataatgctctgggcgaggatcgtagccgtagtcgtaccgtcaccggcatcgtcattggtcttggaggctacttctttcaccaactgggcacccatgttctcgaacgggcactccaattctatctctttcgctacgctcacaccgtccttggtaatgtgcggagctccgtacgtcttgctaaggataacattacgacctttcggcccgagggtaactttaacggcatttgccagtgcatctacgcccttcttcagaaggtcgcgagattccatatcgaatttgatttcttttgccatagtctttattatttattatttattttttttcttttttggaggattattgtctcttcctttaccactggggtttcctgtttttgaaggccaacctgcagtgttaacttgttctgatttttttgttttgcccattagatgattgccaagacatcgttttggcgcatgatgatatatttttcaccctccagctctatttcagtgccggcatatttgccgtagagtacggtgtctcctgctttgagcaccatctcttcgtctttcgtgccgttcccgacagcgattacttcacccttgagaggtttctctttggccgaatccggaataatgatcccgctcactgttttttcttctgctgcagccggctttacaagtacgcggtctgccaatggtttgatgttcattgttgcttggtttgttattgttagttgattgtttgcctgtacaaatgggaagcctcttatgtagctccgcaatttttatgtcaatag

SEQ ID NO: 896 - DNA (genomic), 3393 bp, PORYPHYROMONAS GINGIVALIS; double-stranded, circular
  misc_feature 1...3393
  hypothetical: NO
  anti-sense: UNKNOWN
aagtgtggctgtccaccaccaccgccctgtatatgcttggcggcacttcgtaccagtttggctgcatccatccctccctccgtgagatctttcgaaagcatcactgtcagcgcgcatttttcaccaccttcggtcgttcccgctatgaggacgaagctctcttgcagttcgccggcaatttggaaagctatatccttggccgtctctgcctccatgatctcctgaaagaggaaaagacggataccacggcgacgaacatcctgctcgagaagcgactttttgaacttcagcatgcgctcgtgcttcatgtccgctatctgttttttcagacttgcatcctcttcgagcattttcttgatggacttgatcaggttcggattgttgttgaacagctcctttacagccagcagaatatcttctttctcgtatatgaaacgttcggcaccgatgcccgttacggcttcgattcgacgaacccccgatgctatcgaactttcggtaacgatacggaatgccccgatcatgcctgtagagggaatatgtgtacctccgcacaactctaccgaagagccgtacttgagtacgcgcacttcttcgccatacttctctccgaagagggccatggctcccatagcctgtgcttcggcaatcggcacatcgcgaaactcttcccgttggaagtcggcacgtatccgctcggataccaattcttccaccttgcggatctcctccggagacatcttgccgaagtgggagaagtcgaaacgaagcacctccgggctgacaaacgaacccttctgctccacatgcgttccgaggacttcgcgcagagcttcgtgcagcaagtgcgtagccgtatggttggcctctgcctggcggcgtttgtcctgattgatccgtgccacgaaagtatccgtcgtgctttcgggcaatttcttcatcaggtgtaccgagaggttgttttcgcgtttggtgtcgaatatatcataggctacacccgattcgtcgatcagctgaccgctgtcgcctacctgcccacccatctctgcatagaaaggagtgtccgagagtaccacctgaaagtattccttgtttttctgtttcacctgacggtagcgcaggatctctgtttccgtttcggtgaagtcgtatcctgagaatttggattcaccctcacgtagcactacccagtcgccggcttctacggcagcggcattacgggcacgctctttttgcttctgcatctccgtgtcgaagcctgattcgtccaccgtcatcccattttccgataggatcagggctgtgaggtcgaggggaaatccgaacgtatcgtataattcgaaggcagcgacaccgtccaatacggtggagccggtagccttattgtcggctatttttttctccagcaggcggatacccgtttccagtgtacgcaggaaactctcttcctcttctttgatcacgcggctgatcagttcgcgctgtgcttgcaattcgggataagcatcgcccatcgtatcgatcagtgtcggcagcaatcggtacatgaacgcttcgcggcagtgtaggaaggtgtagccgtagcgaaccgcacggcgcaggatacggcgaatgacatagccggctttggcattggagggcaattggccgtccgtgatggcaaaggcgatagtccggatgtggtcggctactacgcgcatggctatatccgaggtagaatcctcaccgtatccgattcccgtcatcgtagccaaagtacggataagaggctgaaagacatccgtatcgtaattggaagtcttgccctgcaaggccatacacagacgctcgaatcccatgcccgtatcgatcaccttgtgtggcagaggcgtcagggaagcatcggctttccgattgtattgcatgaagacgaggttccatatctcaatgacctgcggatggctcttattgatcagctccaaaccgtttatttgggcgcgctcttcgtccgaacgcaggtcgatatgtatttccgagcagggaccgcagggaccggtatcgcccatttcccagaagttgtcatgcttattgccgttgatgattcgttcttcaggcagaaactgtgcccagtaagatgccgcttcgttgtcgcggtcaaggccttcttcggggttgccttcgaatacggtagcatagagacgctggggatccagacccaacaccgtcaccaagtattcccaagcccattcgatggcttctttcttgaagtaatcgccgaacgaccagttgccgagcatctcgaacatggtatgatgataggtgtcatggcctacctcttcgaggtcgttgtgcttgccgcttacacgcaaacacttctgcgagtctgctacacgagtgtatttagcctcggtatttccgagtatgatatccttgaactgattcatgccggcattggtgaacatgagcgtggggtcgcctttgatcaccatgggggcagagggaacgattttatgaccttttgaggcaaaaaaagtcttgaacgactctctgatttcttttgacgtgagcatattcgattgcacgtagtaggttgttattctttgataatgaggacaaaaatacgaatttctttcctcacagagggataacagagagagtggaacagatgtttttctgtggctatatcttatattatagccaaaggattgttgtaaaataaaaagattaggaaacggatattttccggtgagaacctactttctgttagattgtaagcagtttatattaaatcgtatagtgaaaaaggctgtttgtgagatgataaaacgtaggcacccgtcaaattcgtagaagaattcgacgggtgccttattagtttggaggatgagcgaggactattgtatttgaaaatttatgctgttgctttgtctttttctttttcaggactgttgcattagaaatcggatgatgttttggcaggttttctgagggcatttatctttttgcagagcattgaatgagacctgttgccggatgtggaatccaaagatgctatagccatcttttcgtttctatctcacgtcggctttcgtgtaaaggaagattgcgaatttagtttgcttgaaaagcagtggttttgagcaatattcgaactgtcgattcaggcttatattcttcgctcattacactatatcgatcacaaagctaaaggattgtacccgctctaatgccttttaggggattgaactttttccttacatttgtccgcgatgaagctctctatgaggagttgaatatcgctgtcctgagagcctttcatccgaatgaaattatatagataaacgattaaatgatagttagatatgtgctgcgaataccctcatgctcctaatcttttcggccgattaagccggc

SEQ ID NO: 897 - DNA (genomic), 3236 bp, PORYPHYROMONAS GINGIVALIS; double-stranded, circular
  misc_feature 1...3236
  hypothetical: NO
  anti-sense: UNKNOWN
gggacatcgacttgcttcgtctcaatctgactgaatacttaccggattcggcttcctcttgtattattctgacaggcatgagcggtaacgaacagaccgagaggatcgcgacggaattggtaagttcattcgagaaaaagggaaagaatttccaaattctccaccttgaagaatcggacgctgcactcaaagagatgactgctttgcgtgaaaagggtatatctgttttcgctattgctccgagtgtagtacgtagtgctttggctgttgaagttagctttggggcggatgtttccttgttgttggctgaaagtatgcactcgaagagaaatgataaagacgaagttgaagcatttatctgccaaagccgctgtcctgcttttgtgctatggttggataggtattaagggggcattcatctctctaactcaaaattattatgggtattatccggagcatattagacaccgatctatataaattcaccaccggctatgcctatgccaagctattccccagagcttatggcgaatttcgcttcatagaccgtaatcggcagggctttacggaagaatttgcggagctggtgcgaggtgaaatacgagcgatggctgctctgtctttgactcgtgatgaaaaagagtttctccaacgagagcttccttatcttccaccgatatatatcgattttctcgatggcttccgtttcgatccggaagaagttacagtatcgatagacgcacaaggccacttggatatacgagcgcaaggccttctctaccgagtgacactttgggagacgcctatccttgccgtcatcagcgagctgtactatcgttttattggagccgagccggattggaaacaagtagaagaggtaactcgatctaaaggggagctgatgcgagagcatcgagctacgttctcgatattcggtatgcggcggcgtttctcccttgaagtggaagaccgtgtgacggatattctcaagcagtatgcaggtgagagtctctttggtacgagcaacgtacaccttgcccataagcatgggctacgtgtttccggcacacatccacacgaatggatacaattccatggagctatttacggctataagatggccaattatgtagccatggaggattggatcaatgtctatgacggtgatcttggcactgtgctgaccgatacgtacacgactgatgtcttcatgcgcaatttcagtaagaagcatgccatgctctttaccagtctgagacatgacagtggtgatcccgagatattcatagaaaaagcagtgcgacgatacgaagagctgcgagtggatcccaaaatcaagtacattatattctctgacagcctcactcctcagcgagctatagagattcaaaagttgtgcgccggcaggattaaggccagctttggaatcggtaccaatctgaccaatgatgtgggggggggcgtagagccgttgaatatcgtaatgaagctctggaagtgcaagatgacggcgaaagacgactggcactactgtgtaaagctgagcgacgtcgatggtaagcatacgggagagccggaagaaatccttttggcgatgaatacactgggtatcaaaccgaaataatgctgacgggactattcttcggatctttcaatccgatgcatatcggtcatttggcactggccaattatctgacagaatacactccgatcggacagttgtggttcgtaccaagcccgttgaaccctctaaaaaatacccaagagctgctcccgtacgatctgcgttgcgagctgatagagcaagccattcgtaaggatatccgttttcaagttctgcgcattgaagagctgctcccttctcctcactacacgatacggacgcttcgtgctctctccatgctgtatcctcatcatcggttcgccctcctgatcggggcggacaactggcagagcttcgatcgatggaaggatcatcatcggctgatggccaaatacgagctaatcatataccctcggttcggctatgaagtagacgatacgacgcttccgaccggatgtcgatacatacatgatgccccgcgaatagaaatctcctctacccaaatcaggacaagcatattggaaggaaaagatctacgctattggctacctctccctgagtctcaggacgtcatagcatctgccctgcaaagttgtctgtcaccaaaacgctgaaaaaagacaagctatggaagaagaaagaatggtcacgctcgtctgcctgcaaagcaatgctttggcagaagaactccaacgaatgcttgccgagacaggcatcacggcctatttgcgtaatgaatacaccaaccgtatcataggccctatgtgcgatgtcggcggtgtgagaattgaattggccgaaagcgacctcgaggctgctcgtattgttttggcggagtccggattgccattggcagaaccggagcagaccccagtagggcgtatcagccgatgggcagacaacttgcctctcctgcgcaatcgtcctttggaacaacggttatggatcattacgggactgctcctggtctttctcggactgctttccatcatactctatctcttaagctaaagcaatatgcccaggcgtaaaccgcttagtaacagtcagattatttgtatcgcactcctttggatactgctcgtagtctatgccattggggcaggaaaaccgagtggacaattatttttcggcatcatcgcctccggtatcatcgtatttgtcactatctacaaagacattcgtcgcagaggaaagtagaacgactcgccacttttctctctgatatcactctcattacaatcccatgtatcattgttctcgtaagtctctcaccttttttcttgccttgctattttgtgttatggttctttttagctgtggcaccaagcgaaaactgccttcacaagtccacgccgattatcccaagcgggagttccgtgcagcttggatccaaaccgtctatcagggagaatacgctcgtctctctcctgccgaagcacgtcgtctgctgatcgggaggttggataaactcaaagaagccggctgtaatgcgatcattttccagatcaggcccganagcgatgcctggtacgaatccgctatagagccgtggagccgtttcctgacaggccgacagggacaagcccctacgcctttttgggatccactggcttttatggtcagcgaatgt

SEQ ID NO: 898 - DNA (genomic), 6173 bp, PORYPHYROMONAS GINGIVALIS; double-stranded, circular
  misc_feature 1...6173
  hypothetical: NO
  anti-sense: UNKNOWN
gacggctctccaacattcatacctttgacgccatgccttgcctaggcacgagcattgacgacttggatgtatctctcattcgtaaggagtttttgcccaaggctgtggcagaggatgttctcggtgaagacaaacgagatatcacggatcaatttgcctctcttggcttatatgatttgcgttataactgtccgactaatggggctattgtcctattcggaaagaatcctgagcgacacgtacatggggcgtatattcaatatgttcgcttcaagggtaaggatcgtgcgggtgatattctcaacgaacataagtttagcggtaatctttgtcgggtattgcctaagattgatgcttttgtcgagacaagtatctcacaaaagcgtcccattcccgtgagtgtacttcgggaagaaacagtttccaagtatccatactgggctactcgagagttgttgatgaatgccattatgcacagggattacgagggaaacgctcctattcagttttatgagtatgatgatcgcattgagatccaaaaccccggcggattgtacggcaaggtcagtcccgacaatttccccaatgttagcgattatcggaatccctttattgccgaagcaatgaaagtcttgggctatgtaaaccgattcagccgtggagtctatcgagttcagaaggagttggaagaaaacggtaacgggcaagcctcttttgatttttcattgattacagcttttcgagtagtcgagaacgtttctcaaaagtattttgaagaaggctttgggggagaaacagcccaagaaaagcacaggaaagacccaagaaaagcccaagaaatatagaggatgaaatattggatgaaataaaagactttccgcaagttacaaggaaagatttagaaaaaaggttaaacagaacggaggatagtattcgttattatcttaggaggatggttaaagaaggagttatcaagcacgaaggctctacaaaggcaggaaagtggataatagtcaaatagaatgtgaagaaggtgttgtacataatattgagcggtcttttattgcttgtattggttgtcgtgctcacaggagcactccttccgagaatcagaacgaagacaaaacagtgcattttgaatgctcctgttgatgtcgtttttgctatcgtgaccaacaatcaagaatggcattacagaagttctttggatgatttggagatcatccgtatccaaggggatattgaagaatggcgaagagactgccaatggcgtaactatcagattcaagacacttgagaagagaccgcattctttctacagttttgagatggatagtaaaatgttcacagggaagtggcaagcaatatttgaaccgatggaaggaggtaaaaccctattcactgcaacagaaaagatagaatacaagaacctgttctatcgtttggttgggtatgcttttatggacttaaacaagtttatgaccacataccaagaagaactcacagctcgaatagaacttgaaaaagcagagcaataaagacgatataaccgattgtttgtaatagatttaagaaatcagatttgtaccatataattgcaatacgctgtaaatcaatatagatttgttttgaggaagaagaagggtaagctacttgctttcgttagctgcaatggccgtattgagagcggagcaaaaagcatcagcctcttggaacgcaatgaatgagaccccggtattagtcctgagttctacattgtacttgctgttttggccaagttcggcacccatgtaatccgatagaggacgcccttttgtcgtgtagaatccgtatgcaattaccttgcgcagggttttcgtctcttcatcgataaggtaggcttccggctgcaaacccataaaatcgagtataataagaagtatgtgcctaagtaataaccagacaaattggcaagagagaaaatccacaagataagtgtaatgatcgttacaacgatgtaaaatatcgagatccaaaatctggctccacgcttttcagagaaccctcgcacgtagaattttttctgggttgtcatttttcagtcttgtttattgttttcgatggccctgttcatttcctcacagaatgcctccggctggtaaagctcgacaaaagtatgggttttcatggagagtagttttactcttcgagtgtgggtttcatcacattcggctcggacatactccgtcagaggttttcctccagtgagtattcgtccaaagccgactatccaacgcagtcgcccgttttcttcatcaatgactactgccaccggcatacaagcccacaggatgagtgcaggaatgtaaaaagagacctttgcacggcgattggcgtatattttgtttgttaattcattgtataatagggagttattttgtatatttgagtattaaaaacagcataatattcctcccatggcataccaatccaagaataccgatgagcatgtaacatttgcagacgcactcctttcaaagcgttatcgcaaagcacaaaacgacttcctcaatcaggttgacaggcttatcgattggcgtccgatcaggacgctgatcaacaagaaatacaccaagcgacaaaatgccatcggcgccccggcttatgacgtgattctcttattcaagatgttgcttttggagacatggtacaacctcagtgattgtgctttggaggagcgcatcaatgattcaatcaccttttcccgattcttggggctgaagatggaagaggtttctcccgaccacagtaccatcagtcgatttcgttcggcactgacagagttgggttcatggacaaactattggcgcagtttaacaaacaactttcccgccatcacatttcggtcagggaaggggtgcttgtcgatgcaagccttgtggagacgccgcataaaccccaacggaagcattacgattgaagtcgcagacgacagagaagacaatcggagcgaggaggaaaaagaggcagaggaggattatcaaaaacaggttgtccgtcagcgtaaagggacggatgaagaagcccgttgggtttacaacaaaagcgttatcactacggatacaaaaagcattgtcctgaccaatgttcaaggcattgttcaaaaggtgataacgactgcagcgaaccgcagtgacacgaaggagtttattgcgctattgcagggtgcaaacatacctcaaggctcagccgtcttggcggacaaaggatatgcttgcggggaaaatcgttcctacctgcaaacccatcaccttcaagacggcatcatgcacaaggcacaacgcaacagggcattgaccgaggaagagaagcaacgaaacaaagcaatcagtcggatacggagcaccatcgaacgcacctttggcagtattcgccggtggtttcatggcggacgatgtcgataccggggacttgccaagacccatactcaaaacattcttgaaagcatcgcctttaatttatacagaaccccggggataattatgtcctcatctctaggataaggcataccccccccttgaggagctcgtgcaagcagctcctcaaggggggatttacaactactttcactccttactgccacccctttcactcgctccttttttgccaagaactcctctttactccatctccttattttgcaaaggtctctatagaggaaagagactaaaattttcaaacgcgatcgtcctgctgcattgtccatttagaaaatattcttatatttgcaccgtcattaagagatgcctcatgtatttcttgattaggagagatggcagagtggtcgattgcggcggtcttgaaaaccgttgaactgcgaggttccgggggttcgaatccctctctctccgcaataaagggtgtaaatcagcgagttatgcgatttacacccttttctacacccagaaatgccgatagcctataagacgataaacgagcccttggagcttcttgatggagcccaaagggctcggcttgttttcccacattctcctaatacatccttccctttcctaggctattcgggcgtgctcatttcgcctatacatttgcagtgtcagagctattcaagacgatgcttgaagactctcgaaggctcataaagcctcattcaattggattgacaccgcaatgtataagcaactatgacactacacgaactcctcgaaaagcccgtatggaagatgacgggtgaagaactactattcctagcccaacagggatcaacgcaacaagagggagacacacaagacaaggcccccgccaaagaagaaagacacttcgtttacggactatcaggactcgcccgactcttcggatgcagtctccctaccgccaaccgtatcaagcaaagtggaaagatagaccgagccatcacgcaaatcggtcgtaagattatcattgacgctgaccttgccctcgaactcgctgggcgcaaagtaggaggacgaagatgaaccaccccaatgcaccctttcagccaccgatggacattgatgctgtgtggcaacattcgctcatccgtgtgacggatgcctttgctcttccacccatcgtcttgcgtgtggatgacgctatcatcggcacgttgggcaacttcagtgtgtccacgggcaaggcgaaagctaagaaaacgttcaacgtctgcgccttggtagcagcagcccttgtcaatgggcaagtgctggaatatcaagcgagcttccccgagagcaagcgcaacattctctacttcgatacagagcaaagtccttatcattgtcagcttgttctgcaacgcattctggctttagccgaactccccctagaccaacaacccgaacatttgctgtttagccatttgcgctcaatagctagtcccgaagagcgtagagccatcatccgctatgccatttaccacacacccaatgttgggctagtcgtcatcgatggcattcgcgacttgatgcacgacatcaacaactctgccgaagcgaccaatcttatgggcgacctgatgcaatggactggagagaggaacatccacattcaaaccgttctgcatctcaacaaaggagatgacaatgctcgtggacacataggcacagaactgaacaacaaaacggaaagtgtcttgctcatcaccaaggacaacagtgatgctgacaggagcgttgtctcagcgtccatcattcgctctaagcctttccctccctttgcgtttaggctcaccgaagtagacaacatctgcctacgcgagttagacacagacttcacggccaaagacgcacagcctttctcctaccaagaactaagtggtgaggagcatcgcacagccttgcgagaagcctttggccaggcttgtgagttgggctatggcgacctattgaagcgactcagctcatcatacttaggtgtcagtggtcgaccttatggacagacgaagctcaaagaattgctccgctttctcgtgaacaaacgtatgctcgtcaaggctagcagaggacgctatcagttcaacccagacttccattactgacacatcggttcggtcgggcgcaggctatatatgcctgaccaaccgaccaaccataaataaagaatggtcggacggaaggagtgcctatagtaaacgtccgaccgaccaaagaagaaccgccaaagaaaaaacagcatgcagctacacgacatcaagcaagtctccatcgtggactacttagcacaagctggctttgaagcaaagctcatcaagggcgtgaactattggtattgctcccctctacgctcagagctcacgccttcgtttaaagtcaatgcagagcgcaaccaatggtatgacttcgccacaggagaccacggagacatcatcgacctcgtttgcactctccagcattgctccacagcagaagctatgaaacggctatctgcgctgaagggtgtacggctagcaccgtctttttcttttggaggaataactcccgtaagcctacaaagatcctccatggagctcatcagcgtacaagctgtgaagcatcccaagctcttactgtatctctcggagcgagggctacagccctctgatgcctctcccttcttatcggaagtctattacaaagtctctaggaagtgtttctttgcccggggatcctctagag

SEQ ID NO: 899 - DNA (genomic), 721 bp, PORYPHYROMONAS GINGIVALIS; double-stranded, circular
  misc_feature 1...721
  hypothetical: NO
  anti-sense: UNKNOWN
atcggagctaagctctaccgttatgcaggagatagagaggtaattctctaagtacttgcgaatatcctcacccttcaaagcagcattgctataccgactttgtatttcttcaagctctctcttccgctttgggtcactttccgtatctatctttcgggtaataccatctttttcatcctgaaaagcatttttgaatttctcagcaagttcgatgaagattttcccttttatctcttggagtttctcctcttcaagctctcctttggcaaaaagtctatcagggaataagcccacctttttagaagtttcttctggaacatctttgccatctcgatgtggagagagaacctcaaagcttccttccggtcgctcttctttgggtagtctttcgagcaattcccgcattatccaagagaagaggtagctcgccgtccaaaaggacttcacgcttcgagccttgtctaaggttttacatatcggcccaatggttattgctgtgtatatctcattactcatgacaattcttatttaattgctcgtaaatgtctttcatggtctcgaaaatctcctttgcatccgttaatgaatcatattcacctacttgagattcaaaattaactctgagaatattcattaaaacattgatagatcaatatcttcttgaacttaactctaagacagccccttatgcctggatgatttactacaacctgcctccttt

SEQ ID NO: 900 - DNA (genomic), 818 bp, PORYPHYROMONAS GINGIVALIS; double-stranded, circular
  misc_feature 1...818
  hypothetical: NO
  anti-sense: UNKNOWN
accgaaaatgccgagattgttgacgtgtactgaaaaaagttgacagttgggcgggatgcaaccagtatccattatgggcaaacatttaaacaactttgaacgccttagcatccttgaggattacctctcggggtcagatagcaaagtagccattgagcagaaatatggtctaagtcatggtctcattcgctcttggcttagtaaatttggactcgaagataaagttcatccggtcccaatgaaagtgtcccaatccccccagagtgagctacccctgaacgaaaaagaagagttagagcagctacgtaaagaaaatcgtgtcctcaagagtcgtctcaagcgagaagaactagggcatcaagcctacaagctacttgtagagttggcagaagaaacctacggcattcagatacgaaaaaactccgaagccaagtagttcaccgtttatcagagccagagcctaggtatcctattgctcgactctgcgaactgcttggctttagccgtcaggccttttataaacgtcatctcaacgatttagctaggcacgaggaggatgtcctatgcagtagtatcatccaatattgttggcacttaagacaagcagagcacctacctcaagccggcttccgagagctcatggtgctttgtcagcaatacttcggccccaagttcacgcttgggcgcgatcgcttttgcgccctactcagacgccatggtatgatgctgcgcaaacggtctgtgcgccctcggacaaccaactctcggcataggctctacaagtatgaagacctgctcaatacagagcctaagtttgt

SEQ ID NO: 901 - DNA (genomic), 2783 bp, PORYPHYROMONAS GINGIVALIS; double-stranded, circular
  misc_feature 1...2783
  hypothetical: NO
  anti-sense: UNKNOWN
tcacggttgccgataaatttcttttcctcaaccttcgtaatgaggtacgtaccatcgcggaaaaagatgatgacatcgtcgaggtcggagcagttgcatacgaattcatcgcccttgagtcccataccgatgaacccttcttcgcggttgatatagagttttgcattggcttctgccaccttcgtggcctgaatggtgctgaaaccgataagttgtgtccttcgcgggaaacgggaagcatagtgctcgtgcagatactcgaaccaacggatggtgtaagcagtaatctcacggatattcttttccagttcggcaatatccttttcgagctgaagcatcatggcctcgtgcttgggcaaattgaagcggaggatccgtgccatgcgtatttccaacaacttcttcagatcgtcgtaggtaatggggcgaataaaacgatgggcataaggttccagcctcgcctctacatgcatgagagcatcctgttcgctctcggcctcttcgaactcacgatctttatagatacgctcttctatgaaaatccgctcgagcgatgctgccaaatactgttcccgcttctcttccaaacggatcgtcagttcttgcttcagcagctcccgtgttcgctccgcactataacgcagcaaatcagtcactcccaagaataccggcttgtcgtccatgatgacgcaagcattaggcgactgacttacttcacagtctgtaaaggcatagagtgcatcgatggttttgtccgaagatacacccgcagccagatgaatacgtatatcggcttcggcagccgtcatatcatctattcgtttgatcttgatcttgcccttttcattggctttcagaatggattcgatcagggaagacgtcgtcttgccacagggcagttcggtaatgctgagagtacgattgtccagtttgcgaatcttagccctgctcttgatctgtcctccgcgccggccgtcattgtaccggctggcatccatcataccaccggtagggaaatcgggataaagatcgaaagactctcctctcagatgtgcgatacatgccatgagcagttcaccgagattgtgcggcaagaccttggaattcaaacctacagcaattccttccgtgccttgtgccaagagaagtggaaactttacgggcaacgccaccggctcgtcctcgctgccatcgtaagaacgtttccagtgcgtaatcttatcattgaaaagagtctcctgagccaaagctgagagtttggcctcgatgtaacgaccggctgccgcttcgtcccccgtgaggatattaccccaattcccctgcgtttcgatcagatagcctttttgccccaactgtacgagagcatcgttgatagaagcatcgccgtgcgggtgtagagccatagtctgtcccgtcaccttcgctaccttgttcatacgaccattgtcgaaccaatggtgcatggtgtagaggatgcggcgttgtacgggcttgagtccatcttctatatggggcacggcacgctccagaattacgtaagaagcataatcgagataccagtttcgatacatgcccccgagatggtgtgtagccatggcaggatgatcaaccggcaggcgattaccggcttcgggaagcagatcggacacagatgactctatatccggttgttcgttgtcgaaagaatctgtcatttgatttgaatagatcgatttgttcagttgaaagaaagggaagggggtaaggaaaatccgttagttctttggatggctgtgtcgcaaattgcgaggcgagcattttctgacgctttcgagcagttgtcccgttgggcaaaagaaacggcaccacggctgctgaacgaagatagaagccaagagtatcagccccgccaagacaagcacccataccgatgccgaacgaaaagaaaaagcggcaaaaggctcccacttggagagatcaccggcaacgttgaagatcaacaacacgacgacgagcaggagcaaatagcgtcttaccgaggtgagtacctttatccactgtggcggtatatgcactttccgtcgagatagctttcccatcaattcctgagctgctccgaaagggcatacccagcggcaataaaacggtttgttcgtgatcagaggcaacaatacggccaaagcaaacagcccgatgagcaaccactgtgttgcaaagggaaatccggtgctcagccaatggtaagtaccctccaaagagaggaacgtccctttaagaaaaccgaggaatacaatactaagcgcaaggagatagaggcgaaaaggtttggcctttgacggggaaaaaaagcaaaccaaagctatcagaatgacggcgatggttccccctgtgcggacgatcccccaaacgtcagcttttttgttttttttttgaccgatatatatctccaagcgtttctgcacacaagtgataacggcttcggacgtataggtggctcccgatacggcatcgacctcttcggccaatgcctcctcggcggtcttgccattccagctttcatataaccccgccttctccactctacgggcaaagctcggtgtctcgtcatgctccagcagcatcgtaccgaggatgcggtcatccggaccaaaggcgatgactacgggagtaggcccgttgtacccttccacgtcgtctgtatagggcgatgtgtagagcaagtaacccaattgacgcgccttggcatccataacaatggtacgagtactatcctcttggacgataccggctgccatcgggtagaa

SEQ ID NO: 902 - DNA (genomic), 3261 bp, PORYPHYROMONAS GINGIVALIS; double-stranded, circular
  misc_feature 1...3261
  hypothetical: NO
  anti-sense: UNKNOWN
gtcgccatggccgctgatgcgtattactacaccgcgatacttctggatacgctccttgttaccctccttgatacgatattcaacagtgatggtgtcaccgctgttaaacttgggatgttctttccctgatttgaactcttcgttaacgattttaataaaatccatttgtattgctttttggattagctaaatactaaacgcaatatacacaggtcgcacgttatttcctgtcagagattacgcaaagcgactgcaaagtaacaaaaaagctctcaatcggcaaaactgaacttcaacacctcatattcagaagaaactcgttcgaatgaaaccacaacaactaatgaccatacaactttaattttaatgcgtcagccctgtataagtgctgcttattgtgcaaaggtctcatattataagtacttttgctcgaaagacaaactacaaggatggaacccttcgtacacctgcacgtacactcccaattctctctgcttgacggacaggccgctatcaatgacttggtggacaaagccattgccgacggtatgccgggtattgctctgaccgatcatggagccatgttcggcatcaaggagttttacaactatgtggagaagaagaacagcgggcacaatgcgacattgaaggactgtaggcgcgaactggatcaactgaacgactcgaagagtgccgacatgctgaccgatgaagagcgcaaccgcattgtcaagttgcagcagaagatagaggagaccaaaaaactcctcttcaaacctatccttgggtgtgaggcatattgtgctcgacgtacgcgattcgacaaggataaccagataccggatccgtatcatcccagacgctccatcgatgccagcggttggcacttgatcctgctggcaaaaaacttgcgagggtacaagaatctgatcaaaatggtcagctattcatggacagaaggacagtactaccgtccgcgtatcgacaaggagcttttgcagaagtatcatgaaggtatcattgtctcttcggcctgcctgggaggagagataccacagcatatcatggcaggagagattgccaggctgaggaggccatcctctggttcaaagagctttttggggacgattactatttggagattcagcgacacgagacgcataatccactcggcaatcaggatgttttcccccagcaacagcgcgtaaatcgcgtcatactggagcttggcaagaagttgggcgtcaaagttattgcgacgaacgatgtccatttctgcaatgaagaagatgctgaggcgcacgaccgtctgatctgtctgagcacagggaaggatctggacgatccgaacaggatgcgctataccaagcaggaatggatgaagactacggcagagatgagcgccatattcgaggatctacctgagactctttccaacacattagaaatacttgacaaggtagagttatacagcatcgacaacaaagccctgatgccggactttcctatcccccccgaatataaagacgatgatgactacctgcgtttccttacctacgaaggggccaggcgcaagtatggagaggatctttccgatgagataaaagagcgtatcgactttgaactggaaaccatcaaaggaatggggttccccggctacttccttattgtacaggatttcattgcagccgcacgaagtatgggcgtctctgtcggacccggccgaggatcggcagccggttcggcggtagcttactgtttggggatccggatatcgatccgatcaagtaccatttgcttttcgagcgttttctcaatccggatcgtatctccatgcccgatatagacgtcgacttcgatgatgacgggcgtgccgaaatactccgctgggtgacggaaaaatacggcaaggagagagtggcccacatcatcacctacggtacgatggccacaaagagttctattaaggatgtggctcgcgtacagaggctgcccttactcgaaagcaatcgtttagccaagctcgaccagacaaaattcccggagagaagaaagtcaatctgaagaaagcaatcgaatttgttccagagctgaagcaagcatcgctaagctccgataaggtaatgcgcgataccctgaaatacgcccaaatgctggaggggaatgtgcgcaatacaggtgtgcatgcctgcggtatcatcattgggaaaacggatatcagcgatgtcgttccggtcagtacggctcccgacaaagacacgaaggaggagctgctggtcacacaatacgaaggctctgtcatcgaacagacgggactgatcaaaatggacttcctcgggctgaaaacgctctcgatcatcaaagaagctttggtcaacataaagcggcgccatggcattgacttgaatatagacacgatccctctcgacgatcctcttacatataagctatacagcgatggacgtaccataggtactttccaattcgaatccggtgggatgcaaaagtatcttagggagctacagccctctgctttcgaggacttgatagcgatgaatgctctctatcgtcccggtccgatggactatatcccttcttttatcgcacgcaagcatgggcgtgagcctatcgattacgacctgcctgagatggaagaatatctcaaagaaacttatggtgtgacggtgtatcaggagcaagtcatgcttctgagtcgcaagcttgccggttttacccgaggccagagcgatgagcttcgtaaggctatgggcaaaaaactcatcgaaaagatgaatgttctgaaggtgaagtttctcgagggggggaataagaatggacatccggaagaagttctggaaaagatctggacagactgggagaagttcgccagctatgctttcaacaagagtcatgccacctgctacagttgggtagcctaccaaacggcttacctgaaagcaaacttatcctgctgaatatatggcaggagcattgagccgaaacctgaataacatcacggaaataaccaagctcatggatgagtgcaagtccatgaagatcggcgtattggtaccggatgtgaacgagtccgaaatgaaattctcagtaaatgccaatggggatattcggttcggtctcagcgctgtaaagggtgtaggatcgggagccgtggagcagatcattgccgaacgcgaagccaacgggctatataaggacatcttcgactttgtggagcggatcaatctctctgcctgcaatcgc

SEQ ID NO: 903 - DNA (genomic), 1911 bp, PORYPHYROMONAS GINGIVALIS; double-stranded, circular
  misc_feature 1...1911
  hypothetical: NO
  anti-sense: UNKNOWN
gcggtgagccctacagcgtagcgagccgagccgtagagttccgctccgggagccgtagaggtggccgagctgagccgtagagcccggcgcagcgagccctacagcgtagctcgaagagccgtagagcgcagctcggtacgctctacggcgtagcccgagtcgctgtagggcgtagctcgaccccccttcggagtatattccgaacggctataaaacaatgaggattcgatctgaagaaaaacatgcaatatgctgtttgtcagcgtatttcacttctcagttcaaagatttcagcttcgagaggctccgacatccgatgagacgtcaaacataaaaaagtaacgcaatgggatcaagggacgagtacgttagatgtagccaaaaggattacaacgtacccttagctccgatttatgaaaaatatttgtcggtggggtttaagatttaccgaaagaaggtgaaattgacagaaccgtaggctctatgttcctcgaatcggggatgttctgtaaagctgaaatccttagggtgctcgaggatgaaaagcccgtcttctgccagtatgttactttctaatactttggtcggtagctgctccagctctgtcaaggcgtagggtggatcggcaaagactaagtcatagcggtggcatactttgttgcgttccagaaataaaaatacatccgtctcgaagactctccagcagttttcttcgttcagatgcttaatgaggttgcgaataaaggctgcatgctcacggcgtttttctatggaagtgacggaagaacaaccccgagatactaattccaatgctatactccccgtgccggagaataggtcgatagccgaaagtccttcgaaatcgaaacggttggataggatgttgaagaggttctctttggcaaaatccgttgtaggacgggcattgaagcttttgggtacatcgaaacgcctgtgtccgtatttacctctgattacacgcataggggaagaagtggaggagagagttcgaatatggcgttacaccggctctttgcacagttcgatatggcggaagaacggctccaatatttgcctgagatcatcttttccgacagagtggtcgcggatattttgttggatacagataacgatacggtcatgctctatatccaaccgtaagctcttccagacggtgaccagatagaaaaggacttcctcctcgatggagcgaacgccttgattgtccgtgaagctgtatgtattggcaaagagcagactacctccttcgaatacgaagaggtcgagtttgtcatgccggagattgagggcaactcttttggccgtatgttgcctgctctgtcgctccgtttctttgaaaaaggggataaagccgggggtgaactctgttccgatctgtgtccttcttagaaattcatagagaggcttgtcccaagccaaaatcagcatcttatcctgatgaggcaggttgtactccatgacggctacgcccttgccttcgtccggcaggtggatggcagtcctcagccaatagtcggctctaccctcttcgtacaaagcgcgaggaatgagaacgtacgaatccggacgatagttgacatgtacgcgacgatatgggaaagtgagatgctggtaatggaaaaaaagttcttttacggcggcgcaatagtcttccgctcccgaatcgaaggggtaggtgcatgtgctgcatgccttgccctctgtatcggaaaggctaaaaacaagtccatccgataggaatcggatggacatatcgtagctttctgcagtgtgagcagagagggtagccggaatatcggaagcagggatttccacgcgctatgcttccgaaattattcccagttaccggtattcttcacttctttcagcgatccgatgcgaaggccggca

SEQ ID NO: 904 - DNA (genomic), 3571 bp, PORYPHYROMONAS GINGIVALIS; double-stranded, circular
  misc_feature 1...3571
  hypothetical: NO
  anti-sense: UNKNOWN
gtacccgcaattacatcaagctattgctgtgatcctatttgccatttgatcgtaataaagttatttttgtctcgcaaattgatttgctatgaaaggaataatccttgccggaggatccggcactcgtctatatccgataactcggggtgtgagcaaacagcttctacccgtttatgacaagccgatgatttactacccgctttctacgcttatgcttgcgggtattcgggatgtcctgatcatttccacgccgcaggacttatccatgttccaacggctattgggtgatggccgtgatctcggtgtccggttggagtatgcagagcaaccctcccccgatggattggcacaggctttcatcatcggacgtgaatttgtaggagacgattgtgcctgtctcgtcttaggagataatatcttctacgggcatggcttcagccaaatgcttcggtcggcagttgccgatgcggaaaagggtatggccaccattttcggctattatgtgaatgatcctgagcgatacggtgtagcggaagtggatgctaccggcaaggtcatcagcctggaagaaaaaccggaaaagccgaagagcaactacgcagtagtgggactctatttctatcccaatgatgtacttgatgtagcagcagatgtcaaaccatcggcgcggggcgaattggaaataacctcagtcaatcaggagttcatgcttcgcaagcagctccgtctccagcaactggggcgtggttttgcctggctggatacaggtacacacgaatcactgacagatgcttccgtttttgtatcggtcatagagaaacgccaaggcttgaagatcgcctgcttggaggagattgcctacaataatggctggctcaccaaagaagatctggctcgtgtggctgaaccgatgaaacagaatcaatacggaaagtatctgcttggactgatcaaatagagagcatccctttcatgaactttatccccaccgaaatacccgaagttgttatccttgagccgcgattgttccgtgacgatcgaggctatttcttcgaatcattcagtcgccaagagatagaaacgggtattcgccccattaattttgtacaagacaacgaatcggcatcccgatatggtgtactaagagggcttcactttcagaaacctcctcatgcccagagcaagctggtacgagtagtacgtgggtgtgtgattgactatgccgtggatattcgctttggatcgcctactttcggcaaatatgtagcagtggagctttccgatacgaacttcagacagttgtttatcccgcgcggattcgctcacggttttgtcgtgctaagtgacgaagtcgtatttcagtacaaatgcgacaactactatgctccacaaagcgaaggagccattgcctggaatgatccgaacttagatattgagtggaaaatccctgcagaggacattatcctctcagctaaagatcaggccaatccgtcatggacggaattgatatcgagcgaggatttccggaatctcttcccctacaatcaagacttatacgaatgaaccgaatactggtaaccggagccgatggtcagttgggtagtgaacttcggttgttggcttcggctgacagccgttttgttttcaccgacttagcggaactggatattagagataaagatgctgtcctccgttttatggaggaatatagcatcgggatcattatcaactgtgccgcatatacagctgtggacaaagctgaggacgatgaagcctctgccgagaaagtcaatcaccaagctgcggctcatctggcagcggctgctgcgaagtatgatgccctgctgatacatatttctacggattatgtatttgatggtacggctaatatcccctatagggaagacatcccgacagctcctctcggtgcgtatggccgtaccaagctaaaaggagaacaggctgtgctggcagccgactgccgatacatgatactgcgcacatcgtggctgtactcatcgttcggcaataattttgtgaaaacgatgcttcggctgacagctgaacgcgatacattaaacgtagtcttcgatcaggtcggtactcctacctatgctgcggacttggctgctttcatacaccgtctggctataggacaactgcccgttaagacggggctgtatcactttagcaacgaaggtgtatgctcctggttcgactttgcagtggccattgcccgaatgagtggtcatacagcatgcaggatcagcccttgccatagcgatgaatatccgacaagagtaagacggccgcattattccgtcttggataagacgcttattaaaaacactttcgacatcagcatccctcactggcaggattctttggctgcgtgtctgaatctgctaaaacattgaagaacgatgaacttccgacgtcatattctcatcaccggcggtgccggttttatcggatcgcatgtggtacgactcatggtcaatgcttatcctgattatgagatcatcaatctcgatacgctgacatatgccggcaatctggccaatctcaaggatatagagtccaagccgaactatcgtttcgtaaaggcggatatttgcaatgccaatacgctgaagaaagtctttgctcattatgccatcgacggagtcattcatctggcggccgaaagtcatgtggatcggtctataaaagatcctttagcttttgcccgcaccaacgtaatggggacgctgacgctcctgcaaacggccaaagaggcttggcatggggaatacgaaggcaagcgtttctaccacatatcgaccgatgaggtatatggagcattggctttcgacggtacgctgtttacggaagaaaccaaatacgacccacattctccctattcggccagcaaggcttccagcgaccattttgtccgggcttatcacgatactttcggtctgccgacagtgatctccaactgctcgaacaactatgggccctatcaattcccggagaaactcattcctctcttcattaacaatatccggcacaataagcctctacccgtctatgggaaaggggagaacgtccgtgactggctctatgtcgaagaccatgctcgtgccatcgatctgatattccatcggggcaagaatggcgatacctataatatcggtggctttaacgaatggaagaacatcgatctcatcaaggtgatgatccgcgtggtggatcgtcttttgggcagagaggaaggctcttcggagaagctgatcacctatgtggcagacagagccggacacgatctgcgctatgccatcgactcgactaagctgaaaaacgaactgggctgggaaccctctctccaattcgaagaaggcatcgagaaaaccgtccgctggtatcttcacaatcaagactggctggatcgggtgaccagcggcgactacctccgatactacgacgagatgtactccgaacgatagtgctttttggctaaatttgtcatcgtttccgaatcaatcaaccaaacaaatcacaataaacaaggaatcaaaaaatgaagaca

SEQ ID NO: 905 - DNA (genomic), 615 bp, PORYPHYROMONAS GINGIVALIS; double-stranded, circular
  misc_feature 1...615
  hypothetical: NO
  anti-sense: UNKNOWN
tctcagcgcgggattgtttcaaccgcaggagcttcctcttctactgcagcagtctccatagctaccgaagtggccgaatcagccgctgcatcttgagcgaaagcctgagtcatgaagcctactgacataaaggccacacatgcaattgttgcaaataactttttcatcgcgagtcttttgtttagattagtacttttcgttttcttttattttgttccttaataatcttctgcgcggagagagcgggattcgaacccgcgaaacgctttcggcgtttacacactttccaggcgtgcctcttcaaccactcgagcacctctccttgtcattccattaaaaactccctacccgtcaacttgggtgcggctatagccttatgcatcagcctcataaccacgaattatgggtgggaggattgccgatcaatacaacgtcttaaccggattcatccgcaaatctatgtttttttcatcattccatccctattttggagcacatttttcagttggaatacttaaatcggacgaataatttttccctcttgaaactgaaaaccgaaaaaacggcatgcatttcgggccgttttttcagccaaaatatccggatccagtccag

SEQ ID NO: 906 - DNA (genomic), 2534 bp, PORYPHYROMONAS GINGIVALIS; double-stranded, circular
  misc_feature 1...2534
  hypothetical: NO
  anti-sense: UNKNOWN
cctagtatttcggcacattctgtaaggatcggtatatcctccgtatagaaccgcttaacagcagggtgccgccattaccgagtcgggatctgtatgcagacatatcgtccagcagaatattacggttgatgtttgcgataatcagatcgaacatcggacagtcggcaagaagagatgcgtcacctatgcgaacatcaatatcccgaatatcattgagagctgcattctcgcccgtgttgcgtatgcaccagtcgtctatgtcgatagctgtgacagaagaggctcccaatttgcgagctaagatggcaaggattcccgtaccgcaacccatgtccagaactctcaagcctcgcaaatccatatcgagaagatagctcatcatcagcgaagtggtctcatggtgtcctgttccaaaggccatttgaggagaaataatcagctcgagcggtatatccggatcggtcggatggaagggtgctcttacaaggcatttgtcttcgatccgaatggggcggaagaagttcttttcccactgttcgttccagttgatatccggttggatctcggatgagtattgccacagaagccccggcagtggaaactgctccaatagcgcaggaatgtcggatgctatatcggtggagacagggatataagcacgaaggcaagtctcgttttgctcgaaactctcgaatcctatttcggcaagttcggcactaagcaggtcgtatgccgtctccaaagtcagttcgtccggacggtgtgtgagttcgaatgcgtatgcgatgtatttcattgcgaagagggtagaagttggctgtgtagtttgattcgtctgttgagatagggcagtccacacacgatggccaagcctttgagcatggatgagaggctgatcgcccaccatacggattccggtccgaagcccataccgataagcagcagagccagcggaatccgcaggaggttccccccgatactgataacggccgggaaaactgtccgtgccgtcccgtagaacaggccttgagtggctatttccagcatcatcagtagctgggaatagccactgatgcgcagataaatacctcccgacagataggcttctttttccggtaccacgagtcggaagacttcattaccgaagaaaacgaaaagcactgtacccagaataccgaaaatggagcagtagagtagggtataacgataggcagaaaatatacgtttgccctgacgggcagcgtaattatgagccacgaaagtagccagtgccgtactgaatccttgcgaagtgttccaagtgatggcttccagttgtccgcctgttgtcagcgttgccactccgatatgtcctccttgctgcgaagccagacggccaagcatcatattgatgatggcgaagagggagttgagagcagctacaggcaggccgatacgcaagatgcgaccgctatgtatattgtccggtcggacgaagaacgggaagcaatccaacagcttatcctgccgtctgagcctgtaaaagaatagaacgaatacgaatacctgagcgatcagcgtggctatggccgctccgatcgtcccccatcccaaaccgaatatcagcaagggatccagaatcatattgagtaccaaccccgtgctactgaccttgaagggtatggagctgagtccggctccgttgtagataccgctgaatgcggtggctgcaaaggtgaaaggcaggccgcatgccactatgcgcaggtaggtaagagccaaagcgtgtacatcgtcctccaaatggtatataccgaggaaaaggtgtgggaaaaggaaaaacaaaagagcgctgacggaggagatcagtagggacatcgaaacgttgtgcgaagcgtatcgtcgtgcttcctcgatggcccccttgccgaggctgtggcctatcgtcacctcactgccggtcttattgattgacgatatggaactggagagccacgtcagtaccgccacaatacctacggctgccacggacttgctacccaaccggcctaaccaggccatatcggtaaagctataggccatctgcacgaaggaagtacccatgatgggcagagccagtcggagcagacgtccttttatttccccttctgtgaggttttgcagtcggatactacccattcagagcctttgctgcattccatccttgcgctaccaaggtaatctccgttccgtctcgtgccacgaggaggtgaccgtcggcctcttctgtaatatggccgatcaggtggatgccctctattcgctgaatatcatcgagacgggtgagaggtacggtaaacaacaattcgtagtcttcacccccgttcagagcggctgtggagagattcatattgaactcttccgccatggctgccgtctggtagtcgataggcaatttgtcgtcatatatacggacgccgacctttcggcatgcgctatatggaggaagttcgggacgatagcccgtccgaatggtccatcatggcaagtcggttgatgccggccgacgcaacttc

SEQ ID NO: 907 - DNA (genomic), 2335 bp, PORYPHYROMONAS GINGIVALIS; double-stranded, circular
  misc_feature 1...2335
  hypothetical: NO
  anti-sense: UNKNOWN
tgaaagtggattcgcccatggagatgttgtccgaagctcccacccgcgtgaaaatgctgtccaccatgccgatacgtgcactttcggccggtacgaaagagcctatctgtgccatcagagagataagggccgtctgcctgagcagggcggacttgccgctcatattggggccggtgacgatgatgacttgctggcggtctgtgtccaaataaatatcgttggcgatataaggttcatcggccggtagctgctgttcgatgacggggtggcggcccgctttgatgtcgatggtaaagctctcgtccactacagggcagataaatctgtagcggcgtgccgactcggcaaaggagaggagacaatccagagaagccaccgcttgactgtcctgttggagaggtgccacgtatcgctgcagttcggctacaagcaaggcgtacagctgtccttcgagggctgctattttctcttcggctccgagtatttttgcttcgtactctttcagctcttccgtaatataccgttcggcactgacgagtgtttgcttgcggatccactcggccggtaccttgtccttgtgcgtgttgcggacttcgatatagtagccgaacacattgttataagctactttgagactgggtattcccgttcgctctatctcctgctgctgtagcttgatcagatagtctttgccgctgtatgccagtgcacgcagttcgtcgagcgtggcatcgacgccatgtgcgatgacggggccgcgaccgagagcggccggagcatcgggcatcacctcacgcaatatcttgtcgcgtagttccttgcacagctccaactttccccccagtgtgcgcagattctcttcgtctgcatgggtacatacttccttgatcggttcgagtgcttgcagggcgacacgtagttgtaccatttctcgcggagaaatgcgtcccatggcgcctttcgtcaccaaacgttccaagtcgcctatctctgtcagatgttcggcaatgatggctcgctcttcaggatgtcggaagaaaaactccaccactcgctgtcgggcttgtatgcgtgcagggtccttgagtgggaatacgatccactgtcgtatacgccttgctcccataggcgttatcgtatggtcgatgatgtcgagcagactcttgcctccctcgttcatcgggctaagcaattcaaggcttcggacggtgaacttatccaagcgtacataccggttttcatccagtcggctcagcgatgtgatgtgttgtagctgatggtgctgtgtcagatcgagatagttcagtacggctccggctgccgttactgccatcgaaagctcttccagcccgaaacctttgaggcttttcaggtcaaagtgcttgagtacgcgtagtcgattgttctccgaggagaaagcccagtcttccatatcgaagataaatccgctccagtggaagaggtcgttgaagcgagaccgctccgaccgttccacgaggatttccttcgggcggtagttggtcaggagtttttccacatagtcggcattgccttgtccggccataaattcgccggtggatatgtccagaagagaaataccgaagacctctttgccgcaggagacggctgcaaggaaattgttctccttatgagagagtacattgtcgttggtcgatacgccgggagtgaccagttcggtaataccgcgtttgaccagcgttttggtctttttcggatcttccagttggtcgcatatggccacgcgcttgccggctcgtaccaatttgggcagataggtatccaacgcatgatgaggaaagccggccaattcgacaaactgggcagctccgttggcacgccgtgtcagcgttatccccaggatctcggaagccacgatggcatcctccgaaaatgtttcgtagaaatctcccaccctgaagagcaggatagcatcagggtgtttttgcttgatctgaaagtattggcgcatcaaaggcgtttctaccacaggctttgccatcgtgaaaaaagttgattggataagaaaaaaggcaagcgaagtgcattgtcccccgagagtctgacggggctatgtcaaaattcattcttggcacagcccccttttaggtacgtaagaatgcctaaagtacaaggtgctgaggctgattaaagtatgtgactgaagccgaatgtcgcaagcaacccggcaatttgcgcattatgacacaccgccatctcagcgtcaaagtactccgcttagagaggttacgggtaagaagagaagaggatagagggaatagggcttgagtggattattcctcgccctcctcttcct

SEQ ID NO: 908 - DNA (genomic), 731 bp, PORYPHYROMONAS GINGIVALIS; double-stranded, circular
  misc_feature 1...731
  hypothetical: NO
  anti-sense: UNKNOWN
agttgatctctaccaaatatcgctatcagctggcagcttctgtaatgctcggacagagcaagaatccgatgcaggcagagatcgatgctccctgcgagttgatcgatttcttgcgtttcggtgcctactatgcgggccagatctatgccgatcaacccatcagtgagaaaggcattctcaatcgggtggagtaccgttcgctcgaaggtttcgttttggccgttactcctttcaatttcaccagtattgcttccaacctgaatctggcaccggccatgatggggaatactactatctggaagccttccactacagctcttcatagcaactacctccttatgaaaatcttccaagaggccggtttgcccgatggtgtggtcaatttccttcccggacagggtagcttgatcggtcgggtagccacggcgaacgaacacttggccggtttccattttaccggttctactgctacgttcaacacgctgtggaagagcatcgccggcaatatagatcgctatcgtggctatccccgtatagtgggcgaaacgggaggaaagaacttcgtgatggttcatccctcggctgaagcatgcgaagtggctacggctcttgtgcgcggagctttcgagtatcagggacaaaagtgttcggctgcaagtcgcgcatatatccctcgttctttgtggcccagcgtgaaagaagtgatgggcgatatgctcgacagtatcaaa

SEQ ID NO: 909 - DNA (genomic), 2378 bp, PORYPHYROMONAS GINGIVALIS; double-stranded, circular
  misc_feature 1...2378
  hypothetical: NO
  anti-sense: UNKNOWN
ggcaaggccaccactttttcctgcgtcatgatgctcgctttcctcttcatcggagagcctatgctgaacttcttcggcgtggacgtctcttccttcggcgtggcaggggctatcgtcctcttcgtgatggccgtggagatgatattcggtgtgcagatattcaaggacgacgggcctgccggcagtgccaccatcgtaccgctggtattccctctctttgcaggggcagcaacctttaccaccatcctcacgctgcgtgccgacggtatagcgatgaccaacattgccattgccatccttatcaacgtggctatgatctacctcatgctccgtttcgtaaaccagctggagcgtttcttcggtaagggcggtatatacatcctgcgcaagttcttcggtgtcattctgcttgccatctcggtgaagttcttcaccggcaatatcgtcaagatcatcgagacgatgaacgaagccttgcagaagtaagcgatgctggactttgctgccatagatttcgagacggccaatgccgagcggacgagcgtctgcagcgtgggcatcatcgttgtacgaggtggccagatcgtacaccgttattacagcctgattcgtcccgaaccggactattacaattaccacaatacacgcgtacacggactgaccgctgccgacaccgagtcggcacggatctttccggacgtgtgggccgaagtggagcctctgatcgcagggcttccgctcgtggcacacaacaagccgttcgacgaaggttgcctcaaggcggtattcaggatgtaccgaatggactaccccgactacccattcttctgcacgctccaggcagcacgccgccaactgcgacacctcagcgatcatcgtctgcccaccgtagcccaatgctgtggatacacattggcacaacaccaccaagccctggcagatgcagaagcctgtgccgccatcgccctgaagctcttgtagaaaacttgccatgggaaacttcatgcccctctttatccaccgggtgttacaagcgtttccataatataaaatcgttaatcttatacaggtcggaaaaagagttcgatcgtctgaatatattttctaactttggcactctctcaattacatttatcatcgggaaccatgtatcgggacatagaagcaaagaaaaccaccttcgcggacgactgcataccaagtcgttctttgcgctttttccgtttgaaatcctctcaaatccttactactgacgatagccccgtagcagctgtcggaatgccgaataaaggcattttacccctcccctatttacatttgtaaaaggctgacaaacagcctgttacaacctctgcaaggcctccatcgggaagtctcgcagcgtatcggttttgcccactcatatctcttttcggagcatcatcgggaagacgtttgtccgcacctgaacaaaaccgccgaagacctgcaaatatcaagtctccgcactttatactttaaaagcctccaccctttatagtataacccctcagggctttatagtattacctccccacgcttcgtatcgggaggcatttcgcccttcaaatctcaagcctttcggccttcgtggtacctcccgggagattttccccgtggttgcacatcgtcatggctcaagaaaaagaacaacgcgagaataatcaccataattcacttaaccaaacaaaaaaaaaacgaaatgctgaccctgtcagtcaagagccgtctcatgaagatcggcaagcacaaggacaagaccatgtactatgcccaagtggacaaaccccgagtaatcgagtacgaggacgtcatcaaagacattgccgagatgtcctccctgaccacaggcgatgtgcgcaacgccatcgaccgactcgcctactacctccagcgcgaactcaccgagggcaataccgtcagactcggacagatcggcaccttccgcgtgtccgttccttccaagtatgtggaaacggagaaagaggtgaatgcctccatcctcaaaaagcccagaatccgtttctatatcaataacacgctctcagccgtagctgacaatatccgtttggctgtctaccgcaacggtcagaaagtagatgacaccacctctccctccactccgagcgaaggcggcggcgaacaaaccggcggaagcggcggcctctaatgtccgtaccaccactccctcgaggtccggccttggacttcgggggagtgatccgaacaaaattcacacagtatatatatgccgctctatagaatcacagtcagacggagaaaaaactccaatggcatactactcgaatccggtatgagtgtcgaagtgctaagcaaatacttctacaatcctctgacca

SEQ ID NO: 910 - DNA (genomic), 2433 bp, PORYPHYROMONAS GINGIVALIS; double-stranded, circular
  misc_feature 1...2433
  hypothetical: NO
  anti-sense: UNKNOWN
ccttgttcgatgtagcggtagtacatatcggtgaaagtctggcaagtgcccggattttcccgctccttttcttcttcggtctttctcttgcgaattatagccatgggtgctgatttttggattatgtggcgtttagaggccgatttagaccataatatcctgccggagggcgtccaccaagctgctggctcctatgcggaaatatgccggcgtaagccattctttgcccaaaagcgtttcgatcagacagtagtatttcacagcatcttcagttgtgcgaatgcctccggacagtttgataccacgtacttcgccaaaaagtccgtagtactgtttcagcaccttgcacatcgtataggctgcttcaaggctcgctccggggtagcctttgcctgtggatgtctttacaaaatgtgcaccgcagaaaagggagagaatcgtagcgcgacggatattctccggtgttttcaatgcgcctgtctccagtatcactttgacggtagctccctttgctgctgctatttgctcttcgatttccgtggccgctgcttcatagtccccacttaggaacttacccatattgagtactatgtctatttcatctgctccatcgcttacggccagtgccgtttcggccaacttaacttcgataaagctctgtgaagcggggaaacagccactgacgctggccactttcacgttttcggctgtgagcgtttctctcacggtggagacgaagttggggtatacgcagatcgccgctacggatggaatcgtgggatctgtgtcctcgaagtcattgacgctctcggtaaactttgtgatggactcctccgaatccgtggcgttcaggctggtcagatcgatgacgccatgcaggaatttcttcgtttccggagtgtcgaatcgtgaatagtgatcccgtattatttgatcggttttcagtaaaattctctcttctgactcggccggatcgaactgagcgaaggccatttcgtatttatttgctgccattgttgtgtagtttcgtattttgttgatgtctttctttgtctctaacggttttcttctcgatattcttatggaatgcggtggtcagatccacaccggtttggttggccaggcagagcagaacccacagaacatcagccatttcgtcggccaaatctttgctcttgtccgctttccttttcactttgttctccgtaccgtcgtgcgatgatacgtgctacttctcctacctcttcggtcaaggatggccatgttggttagctcattgaagtatctgatacccagtgtcttaatccattggtcgacactcttttgtgcctctcttagtgtgatgtcggacatggctctactccttgttgtgggtgtcaatcaatatggttaccggcccatcgttcaccaatgcgacctgcatgtctgctccgaatacgccttgtctgacagcttttcccagttttgcggacaagctgttgcagaaactctcgtagagagggatggctatctcaggacgggaagcttttatgtagctgggtctgttccctttccgggtcgatcccatgagtgtaaattggcttacgaccaaggcttctccattgatgtctttgacggaaaggttcatcaccccttcgctgtcatcgaagatacgcaggttggagatcttggaagttaatagttcgatgtcgctctctccgtctcggtcttctatgcctacgagaatcagcactccctgacctatacggctgtgtaatgctcctctgatgctgacggatgcctccgttactctttgtattactactctcatcgtttcttatttctttctgagtccttcgtataatagtttcgctttgttccggccgataagagcactaagctcttcctcttctgcggagcgtattcgctttacgcttttgaaatggcggagcagatcttcttttgttttcttaccgatgcctttgatattgtccagttcgctctgaatttgtttcttacttcgtacatcgcggtggaacccgatcccgaagcggtgtgcttcgtcgcgtaggtgttgtatgaccttgagcgtttcgcttttcttgtccaaaatcagcggaacggggtccttcgggaaaaagatttcctccagacgttcggccaatcctatgatgggtatcttgccgatgagccccagtttatctaatgtttcgtacgctgcgctaagctgtcctttccctccatctacgacgatcaggtcgggtaggggtaagttctcttccgtcagacgggtgtaatgccgactgatgatttctctcatggaggcgaagtcgttcggcccttcgactgttttcacgtgaaactttcggtaatcctttttgctcggtttccccattttgaaaacaacgcaggctgccaccggactcgtaccctgtatattcgagttgtcgaagc

SEQ ID NO: 911 - DNA (genomic), 7650 bp, PORYPHYROMONAS GINGIVALIS; double-stranded, circular
  misc_feature 1...7650
  hypothetical: NO
  anti-sense: UNKNOWN
acccattcggatttggccaaaatctacgaaaaggctgtacagttccccgatggtggttctatcacgattatcgctgtgaccactctttccggaggagacattactcacgccgtgccggacaacaccggttatattaccgaaggtcagctctatctccgtcgcgacagcaacgtaggtaaggttatcgtagacccgttccgaagcctctctcgtttgaagcagctcgttatcggtaagaagactcgagaagaccatcctcaggtgatgaatgccgcggttcgtcttttctccgatgcggccaatgctcaaaccaagatggagaacggtttcgaccttacggactacgacaaccgtgcgctcgaattcgccaatgactactctcgtcagctcttggccatagacgtaaacgtgaatacgacagagatgctcgacacggcgtgggagctattctccaagcacttcaaaccggccgaagtgaatatcaagcagcagcttgtggacacttattggaagaaataataaccttgtgctacaatggctattaagtttcaatacaacaaaacctcacttcagcagcaagaaaagcagcttaagatgcgagagcgtaccttaccgacgatcaaaagcaaggagagcgcattgcgtctggaggtgaagcgaacgaaggacgaggtggagcgattggaacgccaactggaagaagagatcgtaggctaccgaagcatggtaagcctgtggaacgaattcaaacccgacctgatcagtgtggagggtgtcaagctctcggcaaagaaggtggcaggcgtagtcgttcccgtactcgatgacatttcttacacgatcaagcctttcagtttgttcaatgccccgtcatggtttgccgaaggcattgacctgctgaagaacttggcccataccggaatcgaggccgagttcctcggtctgaagttggagttcctcgaatatgcacgcaagaagactacacagaaagtgaatctttttgagaaagtgcaaatccccggctacaaagacgccatacgcaagatcaaacgctatctggaggatgaagagagtttgtccaaatcctctcagaagattatgcgagccaatatggagaaacgtaacaaaggagaggaggtgatggcatgattaccgcaatgaacaaataccttttcctgatctatcaccgtgagtacgaagctttcttggaaaagttgcgtacgatcggggtggtacacatccgggaaaccaaggctacgaaagatgtggcggaattgcaagatctcctcaatttgcgtaaagagattgcccagaccaagcgcatgctcgcttcgtacaaaagcgaggatgctcccgccgaacagaccctgacacttgcgtccgaagctgacggagaagctgccatgcaggatgctcaggctcttttcgccgaagagacccgtcttaaaggcgcgatcctgtctaaaaagcgggaggtggagcacatggaagtttgggggcagttcgactttgcatccatcgaaagactccggaaagccggctatgaagtgaatttctattcgtcttcctcttcggcttacaaacctgagtgggaagaaaagttcggagcagtggctatcaataccgtacgctccactgttcatttcgtcaccatagggcataaacaggatgccagacccgatgccgagcgaatcaaactacccgattacgatctggctacgctccgtcaccaacaggaagagctggaagctctattggaagcgaatgcgaaggacaaaacttcatttgccgacaatcgtatggctgaactcacggcctatgacaacctcctgtcggacaaattcgcattcaccagtgccatggtacaagccgaaggacaagccgatgacaaactgatgcttctcgaaggctgggtacccgtgtcagaagcttcgactatggagcaggcattggccggagaaggctactatgtagagcagatgcagatagaagaaggggacaaggtgccgatcaagctgaagaacaatttcttcgcgcggctcttcgaacctattacgaagatgtattctttgcctaactacggagagctggatcccacgccattcctggcacccttcttcatgctcttctttgggctttgcttcggagatggaggctacggcttgcttattttgcttgcttctaccctgttcaaagggaaagccggtaaggaactgaaaccgatactcactcttttccaatggctgggtggagctaccacgataatcggtctgctcaccggttcgttcttcggtatagcattggctgaagtaccccagttggcaagtgtcaagaaatacttcctgaatcaggacaatctgatgaccttgtccgttgttatcggtctgatacagatcatttatgccaagattttggccggtatcaagatcaaaatccagcgaggagtgaagtatagcctggccacatttgcgtgggcagtcattatcacggcagtgatattggcattcgctttacccatgatagcaccgaaggtaccggaagtggtgatcaatgtcatgttcggcattgcagttgccggaggtttggtagccttcttctacaattcacctggcaagaatccgtttatcaatttcggtagcggcttgtggacggcttataacacagcatcaggacttttgggcgatacgctttcgtatatccgactgtttgcgatcggactcacgggctctatcctcggtggcgtattcaatacgttggctacggatatgactgcttctatgagtattgtacctcggatcatcgtgatgctgatcattttgctgatcggtcatggtctgaacttcggtcttacgatgatcagttcgcttgttcaccccattcgtttgacattcgtagagttctataagaacagcgaatttgagggagggggcaaccagtacacaccgttcaaacgctcctaaatcacaaaagaacaattcaaaaaaatcataacaactaaacaacacaaaagtattatggaacaaatgttagcttatctcggtattgcattgatggttgcattgaccggtatcggaagtgccattggcgtaacgatctgcggtaacactaccgttggcgcaatgaagaagaaccccgattcactgggtctctacatcggtcttagtgctcttccgagttcacagggactctatggtttcgtgggcttctttatggcatccggcttgatcaccaaattggttgctgccaatgctcttactctgcttgcaggttgggctattttcttcgccggtttggcactgggtgtagtaggtctgatgtctgccatccgccaagcacaggtatgcgctaatggtattcaggctatcggcggtggtcacaacgtgttcggtgctaccatggtgatggctgttttccccgagctttatgctatcttggctcttctcgtgtccatcctgatcttcggtagcgtacccggaatggttggagcttaatccgaatcagggtcaatccatatgaacagtactgttggcaattaaggcctaaaacagcaagaatcgtttcatataggctttggcctaaggaacaataccaaggggtgcaccgaaatcaattttcgatgcaccctttctgcataatgcttaggaagtgaggattatatttctataagaacctcccgctaataccgctataagtagtcgtcccttaaaagtccttttaagggacgattagctaaacgctaaacgcaatatacacaggtcgcacgttatttcctgtcagagattacgtaaagcgactgcagagtaacccccatacaaatccggcacggcaaaaggggagagcctcttggccattatgatatgcgtccgacagactggatgtatttattctgacgaagctgatgacagatcttcaggaggtcgtcggagctgtgcacaagcagatggatttgtccctcgaaaatgccatctttggccgtaagctgtatgtgcttgatgccgacattgaaatcttccgaaataacctgtgtcacagcggtgaggataccggtggagtcaatgcccttgagtgcgagcttagcttcgaacgaggtacgactgtgcaagctccattcggtagagaggatgcggttgccaaagctgcttttcaaacgcatggcaatggggcaagatcgcttgtgtacgaccacagtattatcgtcgttgataaatccgaaagcatcgtcgcccggaatcggtttgcagcattcggcaatctgatagttacgggagaattcgtcctcttgtaggatataagtctttttggtgttgtaagctttcttatcctctttctctgcgggcttaccggatggagaggaggttttgttgcttttgcccgctttcaatgccgaacggatagccctcatcagaaagttaccgctatgttctccctgaagcagttttttgaagctttcgggcagagataccgtacccgtaccgacggcgtagaagaatgtttcgcgattgaggaaaccgaaataggctgcgatcctatccaaaagctcggcagagaccatggattcggatgtccgtataacactgaccactcgttcttccccacgattgatcagctcccgtcttttgcgtcggagaaaagtatctactttcgatttggctcgtgccgtagtcacatagcgcaaccactcttcggtcggttgctggcttttgctcgaaagtacctccacctgatcaccgctgttgagcacataactgagcggaacgagtttgtgattcactttggccccgatgcaatggtctcccaaatcagagtgaagcgaataagcaaagtccaaagccgtagctccctgaggcaaacgtttaatttcgccttttggcgtgaacaccattacctcattggagaatagattcagtttgatcgtatcgagaaaatcaagagcattcggattcggattttccagtatctcctgtatggtactgagccatttctccagctccgaatcttcctccacgttgtctcccttgtatttccagtgggcagcaaatcctttctctgctatgtcgtccatccttcggctacggatttggacttctacccactcgccatccggtcccatgaccgtcaggtggagtgcttggtatccgttgcttttaggattgctgacccagtcgcgaatacggtcgggacgattgcgatatatatccgtgatggccgaatagatctcccagcagcggtttttgtcggggatggtgggtgaagattcgaatatgattcgtaccgcaaaaaggtcgtaaatctcttcgaaaggaactcctttcttttccattttcttccaaatggaatagacggatttgaccctcgccttcatctcataggacatgtccataccggcaaaccgttgtttgagcggtgccgcaaaatgctcgaacatctctaaacgatgctgctcggtgatgcggattttctccttgatggcttcatattcctgtggatgctcgtatttgaagctcaaatcttccaactcgctcttgatggcgaagagacccaaacgatgtgccaagggagcatagacatactgtgtctcacctgctatcttcatttgcttggccggaagcatggagtccagtgtgcgcatattatgcaagcgatcggcaatcttgatgaggataacgcggatgtcatcattcatcgtcaggataagcttgcggaaattttcggcttgggcggaactattgctgaatacctcgccggatattttggtcagcccgtccacgatctgagcgaccttgtcgccgaacatatcgcgcatatcttccacggtgtactccgtatcctccaccacatcgtgcagcagagcacaacagatggacgtagatcccaagcctatttcctggcacacaatccgtgccacggcaataggatggagaatatacggctcaccgctacgtcgcttggcaccggcatgagcatccttggccaagtggaaagccttgtcgatcttttccactttgcgacgatggttggaattcaaatagtcttgaatcaacaaagagtattccctctgaatcaaagcttcctcttcgctgatcgcccccttattttctgtctctatatcgggattctttgcactcgcgtcttgctccataatctattctcaatctacaatgtggtcatactatacaaatgtaaaaaaaaggacggtgtatcatcatgcgcaaattactgtctcgtttgcaatatttggctcagccacgtactttgtattcagccacggtcttagtgccttgtactttacgcatccttacgcacctaaaaggggccatgccaaataatttgacacggccccctcgttattgtatatgtgttgatcgaattagattgtctctttcagatcagtgtatctgtttgatgatctccataccacgctggatggcttgctcgttcatcgggatgagtttgtggtgacgttcgggcagtgtcttcttcagacccttgatcacactttcgatcttaaccatcggagcaaccttgagaacaccaccgaggacaatcatgttgaatgccttttgattacccatgcggagcgactcttgtgtagcatccacttcgtagatctgaatatcgtcgcgcttattcttgagtacgatgctgtccggatcgtaaaccaagatgccgcctttcttaacgcgcgcttcgaacttatcgagcgaaggctggttcagtacgatcacaatgtcgtattcattgagaaccggcgaacttacctgttcgtcgctcacgatcaccgtcacattcgatgtgcccccacgctgttcgggtccgtatgaaggcatccaagacacctctttgtcttccatcaaaccggagtaagcaaggatcttacccattgagaggacgccttgtcctccgaaaccagcaattacaatttcgtaagtcatgatacttttcttttgtttgaatgggtggttagtcgatattcttaagatctcccaaaggatactgtttagccatgttctccatcatccaatcattggatgctgcagggctcatcttccagccggtgttgcatgtagaaacaacttcgacaatagaagtaccctttctgttcatagagttttcgaatgccttttgtatcatcttcttcgtcttgcgaacagctgctgcattgtgcacggtctggcgcgttacgagacaagtaccgtcgagcaaagcaagcatatcggcaatcttcagcggataaccgttcagctctacgtttcttccctgagggcaagtagccgtaaccataccttcaagggtagtcggagccatctgacctccggtcataccgtagataccgttgttgatgaatataatggcnatgttttctcctcggttggctgcgtggatggtctcggctgttccgatagcagccaagtctccgtcgccctgatatgtaaataccagcttagagggattcagacgctttactgctgtagccagagccggtgcacggccgtgggcagcttcttgccagtcgatatcgatgtagcgataggcgaatactgagcatcctacgggggcgatgccgatagtttcttccgtcaagcccatttcttcgattacttctgcgatgagtttgtgcacaactccgtggctacaacccggacaatagtg

SEQ ID NO: 912 - DNA (genomic), 2552 bp, PORYPHYROMONAS GINGIVALIS; double-stranded, circular
  misc_feature 1...2552
  hypothetical: NO
  anti-sense: UNKNOWN
gctcaagacccctcgaatggcatattcggtcagcttgttgttgtccacactgtccacatacaggctgctgatagcatacacagccgtttccagcttacgtagggcctctttcatactactactgagtttctgtgcagatgccgaacagcccagtaggagcaggagtataatcgatttgcttgctttattcattttttacgaaatctttcttatttcagcgtccaaagatagcacaccttagcacaaacgaaaagtctatgacccggagcttccgcttggtatttatacacctcaatacagctaattccgaaacggcaatccatttctcgtctattcattatatttttgtgactgttttacattttgaggagacaatcaacacaattaaataactaaaaaagaaagagtatgaaaagaatgctgctgcttctcgttgtattattatatggaattgcaggccgattggctgcacaagacgttatcagaccatggtcattgcaggtcggagcgggatactccgatacggagaacatcccgggaggattcacctatggtttctatttgggaaagcgtatggggagctttctggaagtggggctgtccatgtacaactccacacgtcaaacagccaacaatgcagactcctttgcatcgaacgaaggagacggatcttttcaggtaaatatgtcttctccgaatgagaagtggtcattcttcgatgcaggcagtgccaactgctatatgatcgtcgtcggagtcaatcctctccatctgttttggcagaatagccggcacaatttgtttctggcagtacaagccggcctgtccaataagcacaatattcatttcatctatggagacaagggagccaaagtcagtatctacaccaattcgaatacctacatcggttacggagcacgtgtagcctacgaatatcaaattcataaaaacgtgggggcgggtgccgctgtaatgtacgaccacggcaataagatgcttacggccatggccacgctctccactcatttttagttgccaaagctcaatcggacatcgctccgaaatccgagctttcgtaacaaaacaaaaaaaccttgcagaagttagacctgcaaggtttttatttggactttgatccggaaaggcaccttttgagaccgttatacaataacccttcccccctcatattgatcaagacagataaatgcattgatttgacgaagaaaggagagcttcatgcgatctctctgcaaacctcaagtaatctgaaaaacacttaagaatcaactctgcggcaaaagacttcaatgaaagtcctataaaatagttgcaaatagctgatagttagcgcattgacgggagcagaatcagctgacaattgcgtcctgcatcgtgcaggaagcaagaatcagctgacaatcgcgtcctgcatcgtgcaggaagcaagaatcagccgacaatcattccttatttctcgcctatcggtacaagcattgatttgacgaggaaaggagtacttctctaatggaaacttgatgaaatttctgtttgcttgctgtgtccatataccgaaggtttgacctttcccgaagacactaagaatctgctctgcagcaaaagagctcaatgaaactcccatgcaacaatctccttttgggaacatcccatcctgaaactatcaactaagtggaatatgcaattgactttttaggctcaaaaagataatggcataggaatatttttatctttgcgagtacatttagcccgaaaaatatgctcccactgccataccgttatgcaaaaaccgagcacctttttctcgcaaaaggatactgcaagaatccaataacaaacataattatcctatttatgaagaaaaagaattttttgcttcttggcattttcgttgctttgctgactttcatcggcagcatgcaggcacaacaggccaaagattatttcaactttgacgaacggggcgaggcctacttctcattcaaagtgcctgatagggccgttctacaagagctggctctgatcatgtccatcgacgagtttgaccccgtaaccaatgaagccattgcctatgccagcgaagaggagttcgaggcattcctgcgctatgggctcaagcctacattcttgactcctccatccatgcagcgcgctgtcgagatgttcgactaccgctcaggagaaaaatacgaatggaatgcttaccccacctatgaagcctatatcagcatgatggaagagttccaaacaaagtatccatcactttgtactacttccgtcattggcaagtccgtaaaggatcgtaaactgatgatttgcaagctgacgtcctctgccaatacagggaaaaagcctcgcgtgctctatacttctacgatgcacggagacgaaacgaccggatatgtggtactgctccgactcatagaccatctgctgtcgaactacgaatccgatccgaggattaagaacattctggataaaacggaagtatggatctgccctttgaccaatccggacggagcatacagagccgggta

SEQ ID NO: 913 - DNA (genomic), 4530 bp, PORYPHYROMONAS GINGIVALIS; double-stranded, circular
  misc_feature 1...4530
  hypothetical: NO
  anti-sense: UNKNOWN
agacgctccctgaaataaggagcttcgccatcgcgatgcgtaatccgatgaaaagatgtgaccaacggaagcttttggagagaatcgcattctgctttagtgatatatttggccttgtacatctgctccagaacgatattgcggcgtcctcggcaacgttctgtctccccatgcaaaacgggattataataggccggattcttgcacataccgaccagaacggctgcctcctctatcttcaaatcagccggctgcttaccgaagtaggtataagccgcagacttgatcccaacggcattgtacaggaagtcgaagtagttgagatacatggtgatgatctcttccttcgtataaaaacgctccagcttcacggcgataacccactcgatcggtttttggaagaggcgtccgagtttggtctccgtgcgcggcgaataaaggagtttggccagttgctgggtaatggtactaccccctccaccgcttttttgattgaggataccgcgtttgaccacggctcggaacagacctttgctgtctattcccgaatgcttacggaagcggacatcctccgtagcgatgagagccttgatcagatcgggtgaaatctcgttgtatctggtatatatccgattgtcaccgctgtgggcataagaaccgaacaccttcccatcggcagatataagctgcgatgcatacttgtcaatgggattctgcaaatgctcgataggcggcatatagccgatcataccggtagcaataaacaggaacaggatgccgataacagcccaaccggcaatgaagacagtccagagtatccggacgatcttattggttagtttactcaacgtcgtattatctatgaattagaaatatcaggagcggactctgccactcctaatcattatccggagcaaaatggccaatcgggagaacgaagggcgaataacatatccgtccgccataatccgagattaaagccactcctgtctctcttaccacgctatttttttcgttccttgatcagtccgtagctgtacgcctgaaggagttttttgaggttttcaacctgcttgctcagcaagtggccattgtccgtatccttcaccagcatacgatgggatgtgacctcacgtaccaccgtgatactcttgatgtcctccatctcttcgatagccttgcgtgtggaactaaacggttcgtgctgcacaagatgcaatccctgagagttgaatatcagcgtatagccggcgatccccgtacttgactgatatgccttgctgaatccgccatctatcaacatcagtttgccttcagctccgataggaagctcccctttcttggccttcaccggaacgtgcccgttgattatatgcgtatcagggccttcaagcccaaactctttgaggatcatctcacaaacggctttctcctgacgatagacgtagtagtaacccttttcctcatgatgcgtagccttatcttcgatgaagtaacgctcgaaagtagtcatcatagctttgtcgaaaagaggagaatccggtccgcaccagaggtaccacatgtagtccacagccgcaagtctctgatcgcttttctcgggagccacatatgcggtacggatcatctcttccaccttatcgagcaattcgcgtccggcataggtcttgtcccctacccgtaccttcttgagcgacttatccttgttcagagggatagaagcatggtagagcagattcatattatacgtcaggtacatactgccatgacgatagaggcatttgagatggttttgcagcttttcactccgcataaaacagcccatcagacgatctacgatattctgctcttgctctgtcagtgcatacggatcggccggatccacggtcgggaaattcatatccaacatcggatatacgccactcgacagcttgatggtaccatcggtgaagttcaccagatggaacaaatcccgattgtccatcttgtactccggatgacgggctatgatctggtgctccagcttgaactgaatgatagatatggctttgtgcatctgactgatcagatagacgctcttgtcatcatacgtctggtcggcctgagccagtttgggtttaaatacggtacagggatcgtccgcataagtgtccatggcaaaacgcgccaagggcaaaaggttgataccgtacccgctctccagcgtatccaaattggcatagcgcagtgctatacgcaccacattggccatacaggaggcattgcccacagcagcttccatccacagcatgtcatgattgccccactgtatatcgaaatgatgatacttcataagggtatccatgatgatatgtgctccggggccacggtcgaagacatcccctaccacgtgcagatggtcgatgaccagccgctggatggtctcactaatggcaatgataaagtcatcggcacaccctgtggatattatagaggaaaagatgctgctgatataagccgatttattgggattgacaccatcttcgtggagtagctcctgaatgatatagctgtacttgggaggaagggtcttacgtaccttggagcgagtatatttctctgcagctttctgacacactttgatcagctgattcagcgtgaccatataccagtcctccatccgctcatcactttgcttcacgagttcgagtttctcgcgaggataatagatcagggtgcacagctctcgcttctgattttggcgcaactgaccaccgaagacctcgtctacctttctccgaatactaccggacgcattcttgagcacatggataaaggcttcgtattcgccgtgaatgtccgccaggaagtgttctgttcctttaggcagattcaatatagcttcgagattgataatctccgtagctgcttccgtcgctgtcgggaaactctccgagagcaattccaaatagtccaaatcgtgcttgagcatctgcacggtttgcgtcttatcgttagccatgtggtgcaaaatttttggtttataattcttccaaaggtacagacttttccatgcaaccgactcttttcggaaaaattcacggttatttccattccgcccgagaacctctccacagagaaaaagtcgccattataccattagggatcaatagaaaagaacccgtctctgacttattaaacgaagtgaagtgtagtacttgtggcagctgtttttatctgatccgacctactttcgacattgcacatcacccttgcaggcacatgctcataacctgccaacataaaaacacgaaccggaaacgctccgactgtggcacgtgttttctgaaaaagtggaaccgcaactttttcgttccggcacgtgtttttttcacttctcgcaccaaaagaaaaattttcccacgccacgtttttaggaggtagaaatataaaaaattcggggcgtaaactatcagaacatgggattcgcgagattatcccaaacgcatccttatacgatcgcctccttatatataatacggagtcgtttctatgcagctgccctatgcaaaatggctatatttgcacgcacaataaagaaagtcattgcgacaaatgagaacaatcaaactgaaagacaaagagtttgagatttacattccggcgactcgcatacatgaagccattaagaggatggctgccgagatcaaacgggatctgcatgaggacaatcccctattcgtctgtatcatgaacggctcgtttatgtttgcagccgaactgatgcaggctctcgatgagagttatcaagtggatttcgcccgctactccagttattgcggtatgcagagcacattcgtgctcaaggagattatgcccgtgacggccgacatgcgtggcaggacagtggtcatcgtagaagatctgattgattcgggttatacgatgagttgcgtaaaggagaatttctacgagcttggagccaaagaggtgcgcatagcagctatgctgaccaaacccgctgcactcaaatgcgatatccataccgattatgtaggcttggagatcggcaatgactttatcgtaggacacggccttgactatgatgatctgggacgcatgtaccaggacatctataaaataaaagaatagatgcttaacgtactaatcttcggtgctcccggttccgggaagggcacccaaagcgaagaactgatccgtcgatatggattccggcatatttcaaccggagagttgcttcgtgccgaaatcaaagctcagaccgaactgggccaagcagcagccggctacatcaacgagggacacctcgtacctgacagcctgatcgtggacatgatggaaaagctcatcagcactttggtcgataccgaggggattatcttcgacggatttccacgtaccattccccaagcagaagccatggagacgatgctcgcacatcatggatggaaggtggacatagtgctgaatctgcaaagtacccgaggaaatgctcatcgaacgcctcctgaacagaggaaaggtcagtgg

SEQ ID NO: 914 - DNA (genomic), 795 bp, PORYPHYROMONAS GINGIVALIS; double-stranded, circular
  misc_feature 1...795
  hypothetical: NO
  anti-sense: UNKNOWN
caagtaaacgaaacggtcgggatcgagaacctgatttccgtgccttacaccacaggatcggaacttgcatccaacctcaattctcacatcaaggccaatacgatctccctcttcgaggcccgaaccgtgtcgtccatcacacaacaagaaggtatatcccgtgtggaagtgacttccggagaagtcttcacggctccggctcttatcatggctacgggtgcttcatggcgcaagctcggtgtacccggcgagaaagaatatacgggtaatggtgtagcctactgcgctcactgcgatgggcctttcttcaaaggcaagcgtgtggccgtggtcggtggaggcaactccggtctggaagctgccatcgatttggccggtatatgcgagcatgtcactgtagtagagtttctggatgtgctcagggctgatgaggtgcttcaaaagaaagcacgtgaaacggncaatatcgacatcctcctcagtactgctaccaaagaaatcatgggcaacggacagaaagtggagggaatactgcttaccgatcgcaacacgggagaggaaaagcaaatcgcactcagtggcgtattcgtacagatcggtcttgccgccaatacatcccttgtgaaagatttggtggaaacaaacagccgaggcgaagtactcatcgatacttcatgccgtaccaatacgcccggcatatatgctgcaggtgactgtaccactgtgccctacaaacagatagtcattgccatgggcgaaggagccaaagctgctctttctgcttttcgaggatcg

SEQ ID NO: 915 - DNA (genomic), 418 bp, PORYPHYROMONAS GINGIVALIS; double-stranded, circular
  misc_feature 1...418
  hypothetical: NO
  anti-sense: UNKNOWN
aacatttacctcaactgcaacagtggattgttctgtctatatatggaggaatactaatatttctcacaacattagaaattgcaaaaacttataacctcggaatactaacccctaaaagagtaaaaagatgaaaaagttatcgttacagagtattggactatttttcgctgctgctgttctgatggtatttctgacagggtgcgaaaaccggtttgacttggaggacattccgcaagaagcggaaatccggacacgctcggccataggcgagacggataacggcagagaatacctgggccgtaatttttacctgacaagttcggatgaagtggtttcggacagtcgatccggagcagaaaggaaaatgctggcccgtacatttaacattcagaccggtctgtgggagcaattgcttagg

SEQ ID NO: 916 - DNA (genomic), 2182 bp, PORYPHYROMONAS GINGIVALIS; double-stranded, circular
  misc_feature 1...2182
  hypothetical: NO
  anti-sense: UNKNOWN
gcaaagccgatagccaccaataagatggctaccgacagataaattatttttttcttcatcgtggcgaattatatttctgttgcaaataagtcgtattagaaagtgatccgaaccaacccgtatatgatacgtccgggtgatgtcggggaattgaatgccaatgctttgggtttataatcgaacaggttctccgcaccgatatggagcgtatagttccgatagaaatgattttcaatatccaaacgacagatcgtataacccggatacgttatttcctcaaacaactcgtcggagttcatacgccctgttttcagatcggaaaggaagcgcgtggagaagttggaggctagtctgtaattcttcgaaaaattatgtccataagagagagtggcagtagctgcatgagggcgggtgtttgagagcttcatctcagttccggccttatcggtcgccttccatcgatcataagtgtaggaatatgaagctcgaaaaccaaagccgtaaggcagtaccacattcgcttgtccttcaaagccgaatattctcatttctttcgatacgttggtgtagatcaaatctgtgcctttgtaggtgaaatcgatccgattgcgaacatgattgaagaagacattccccatcagtgtaagcttgttccagtgagcttctgccgagtatgagagcatgcgactcttctccggcttcaaatccggattgccgtaaataaagaaagcaccatgattgaagaaaaagtacatttcctgcaaagagggggcacgatacccttccgcgtaggacaagcgattggtgacatggctgcacttgtacatggcagacaggcgcgatgtatagtacaagccgaatccggagtgcttgtccaagcgccctccatagctcaatacgagtttgggggtaactttatatatgtactgtccgtataggattttgttgttcacggacttttcccccgggtcgttcggagaggaaagacggggcgatgctacattatcatggatatactccagacccacattgagaaggtggacttcagcaagattgagattgtattgtgctcgcaaatggtgcatatcctcatcgaaaatgggaagtttcttttggttctcagtcttgatcagacaggtatcacggctatattgtcgtaatgataagagacgtccagatccgaagtctcgctgatacgccagttggcaccggctttgacatcgtaggagttgtacagaaaatcgatcttatccgtccagtgctgcttacgcagattcaccagtccggtaaggttgaaggataagttttccgtcggagagattgtaaacttctgatttatattccatgtcgtattgcctgcaacattcagttcctgctcgaactgatcggccaaaatataacttttgtctgctctatattgtacgccggactgactggtgaagatcccacgtttcactcctgctgccacatcgtatttctgtccgtcgcgactatcgtatcgagccgaagcagatacgcgaaaaggatccttggctgtacgggtgatgatattgataacacctccgatggcattagatccgtacaaagcagaggaagctccacgaagcacttcgattcgctcgatgtcatccggattgattcgttcgaagtctattccactggtagatcccgttgaaatcaattcgccatcgacgaggaagagaatagaactttcgtcaaatccctgagcattgagctgatctctggaaccatgcttggtaaactcgatcccgggaagaatatactgcagtacgtcaatgaaagaagatggggctatagctttgatatcctttggccttgaacacctttgtggggacaggtacatctttaagcagcgggctgtacggctaccggtcaccactatatcctcaagtgcgatattgccggatacgatggtgtcggtaggttgggccggagggttggccgcatgggagtatatacttatactaaagaaaagcaggccgatgagggccgctttgttactacacttttcatatttccctcttaacttatttaacggggtatgtataagtgaaagtgatgactccttttttgagttctgcatcctgatagtcagtgaactgcactttggcaatattaccatcagcaccacgaacgaagaagactcttttgcggggatcct

SEQ ID NO: 917 - DNA (genomic), 880 bp, PORYPHYROMONAS GINGIVALIS; double-stranded, circular
  misc_feature 1...880
  hypothetical: NO
  anti-sense: UNKNOWN
ttggttccgtttttcccgaaaagcggtttgagtttttcccgaaaaatggttcgtaattttgtttcttctattcttctctctttcggacggtttcgaggacgagaggaagatctttactccttgctttggattctatcgatctcgattattggattttcgttcttttacattgtattctatatcaataagaaatgctatctttgcggtcgatattcctatgtatggtcataaaagtgacccgaatatgtgtgtccaccatacggggctaacaagtttagtagaaagaaagtaatgtacgttatcgtagacattcagggacagcagatgaaggtagaacaaggccgtcggctgttcgtgcatcacatcaaagatgtagagagtggtgcaagcgtagaattcgacaaggttctcctcgtcgataataatggtgctatcaccgtgggttctcctctggtagaaggcgctaaggtggtatgtgaagtattgactcctcttgtgaaaggggataaggtgctgatcttccacaagaagagaagaaaaggataccgcaagctgaatggccatcgccagcagtttacggaaattctggtgaaagaagtcgttgcataatcaaatcccaaaacagaaacacaatcatggcacataaaaaaggtgtaggtagttccaagaacggtcgtgaatcggaaagcaaacgtcttggcgtgaaagtttatggtggagaaatggctaaggccggcaacatattggttcgtcagcgtggcaccgttcaccacccggtgaaaacgtaggtatcggtagggatcatactttgtatgcactgaagtcggcgtggtagtattactcgcagaaaacgaccgtcatacgttcgatcagaccgatc

SEQ ID NO: 918 - DNA (genomic), 775 bp, PORYPHYROMONAS GINGIVALIS; double-stranded, circular
  misc_feature 1...775
  hypothetical: NO
  anti-sense: UNKNOWN
tttgatttgattcatgaaaattagtcagatttgtcatgcaaatcttatgtaacaattcaatagcttgtttttcttccttagtttcaaatctattaggatgaagaaagcatagtaatttagaatcatgtaggtcttttggaactacaattttcttttttatatctgtactcattctttattattttacataaattgcttttacaaaaagcacccgatattctcaccgggtgttaactacaaaattctcaattgtagatagcataaaatctattcataatggagtttttgtggtaaaggtagggaattacaacttatttctttggttttccttttctttcttttcagagaaaatgagtaccatgttgaactaactgtatgttaaaagctagtgaagcctaaaatacatgagtttgggataggaaaagtcttataaaagttagtaatcacagaaatattttgcatgcttgatgagtttagcaagaattttgatgcggaaatgcaacatcattcgcttcctaccggtttcccaaaggctcgcagacgtcgtaaagtctcacttagtgacagtgagattatgactattttgccggtgtttcatttcggaacctttgctaatttcaaacatgattatttgcatttcatcaaagtgcatttgcactccgagttcccttcggctgtgtcgtacaatcgctttgtggagcttgaaagccgcgtgttctttcaaactcatgctctttcttaaactctatgccctttgggaaaaatgtaccgggcc

SEQ ID NO: 919 - DNA (genomic), 566 bp, PORYPHYROMONAS GINGIVALIS; double-stranded, circular
  misc_feature 1...566
  hypothetical: NO
  anti-sense: UNKNOWN
cgttgttgtggcaagagcacgtgatgcttatgctaaaggagatacaattgtttttaacagcaagaattacacactggggaatgaacgtaatcttggggatgtagtaaaaaagatgcctggcatgggaagtttgaccagacaggaaatatctcatatcaaggaaagaaaattggaaaggtcttggttgacgggcaggatattttatcctcttcttccggtgttgccatgaatacgcttcctcctgattttgccaattcgatagaattgctttcgaattatacggatggtgatattgcccatgctttcaaggcataagaacaattagccctcaatctgaagtccaataaaaaagttgctttaagcggttcttttgaaggcggangcggcctgaaagacaaatttatcagcaaagcatctttgattacagtcttaccaaaaatatctgccagtaccatcattaacgccaataatacaggtgaggctgttttttcgattcaagattatatgtcgaatatcatagactttgaatcgatccgaagtggagcttcaacgcagacatctttaag

SEQ ID NO: 920 - DNA (genomic), 991 bp, PORYPHYROMONAS GINGIVALIS; double-stranded, circular
  misc_feature 1...991
  hypothetical: NO
  anti-sense: UNKNOWN
ggaggctttttcgttgtagtagggatttatctgttgttctttctgatcggatacctttgtcggcatctgatcagaagatatatcctcggacggctggccggagaggtactggaaattgtagcccgccatcaaagaaaaaaagaagaggatgaagggccgacaaataagtagatctcaaaatgattgtcgcgcaaaccgataatagaaatagatatgcgagcatattacgaactgaagcgtcgtcgagacgcatgcgataaggaagcagaacgataccagaaggacatctttcgctgtttggatcatgtacgcaacaattatggcgacatgattttcgaagaagttgagacccatctgatctatcctggcagccttggcaataagatacttcgcttcctcatcggcaagaagcagatctcttcatccaagctaatgactccgacaggccggccgactctccatctgatcgagcagcttaccgacttcggccgtcctttgctgatcagtgccttgcttggctttgttaagcgtagcatcgttcgccgtttccgcaggcgtcgataatttcccctattctgtcttttcgggtaaggaacattttatgtcagcggctgacaaagcgatataattgttgtctgcctgaaacaattctccatgaacacaaaagaatatgtgctggactttatcaaccgcacgaactgtaaccttttccttaccggcaatgcgggcacaggcaaaacgaccctgctgcgccatatagtccaacacacattcaaaaactgcatagtagccgctcccaccggaatagcagcgttgaatgccggtggggtgacgctgcattcgcttttacagcttccgccgggaacattcattccgtacgggctatctctcgaaagtgcaacgggcgtaaacttccctacgccaacttctttttggaaacagacacgtatgcatgcttcgaagcgcaaattgcttcgaaacatggagntgc

SEQ ID NO: 921 - DNA (genomic), 430 bp, PORYPHYROMONAS GINGIVALIS; double-stranded, circular
  misc_feature 1...430
  hypothetical: NO
  anti-sense: UNKNOWN
atcttctatacttgatattattgattacctcctattgtcagataatcccactatagttgagaatattattaatgaaaatgttgaattctatggaatgaatatatttcttgaagaaagaagctacatcctaatgaggaaggcacctcattcaggacaaggtacgcaagatgtgtattggaaggagcaagaggaatatcctatgccatacatacagactcactctgtgggtgagatgagaacaattctgacaaggatgttttatgttcctcagcatgaaactaaagttggtaatcggaagtacaatatgaccttcaggcattttttgccatttaattatctaacagaggatattatttcatcagcaaacacttattttgatacggcattttttattaatcgtagttatgatggtttccttgattatgcatta

SEQ ID NO: 922 - DNA (genomic), 3111 bp, PORYPHYROMONAS GINGIVALIS; double-stranded, circular
  misc_feature 1...3111
  hypothetical: NO
  anti-sense: UNKNOWN
ggcgcaagatggctgtacgtccgcgaagatcgtcgtctgacagccgttcgatttcgccatatgcaactttgattttgtccacgaaaggttttacctctttcaagtcacgctgcgatttgttgccgaaaagcttcgacatgaattcgttgaatcccatttatctattgtattttttgtagctgttatgatatgtgcggagtacccgcgtaagagcgaaagactcctttctcttcttcccgaatagtatgttcagagagccacttcgggtaatggcaaggcacgagcctctgtcggaggacgtatgcggaggatatacgccaaggtgggagctatctctgtcgaagaaatagttcgctgcactttttgtccttttatgccgggtaccaccaagataaaaggagctgctacagcattatagcgtatttgtttgtgatccgaattcgaggatacctcctcttctccttctatccatcctccttgtaattgcaaacatacatccgcagattgccccaatcggaacgaacgaacaaaacgattcgcttcttcgttaattgctcccgaacctatttcgtgcgccggcaatgcaagtcgtacaccgctcatctgtcgggcaaattctgccacttctgattgaagccgacgcatatcgacctgtttcttttctgccagttttttgtccagaatcaactgaccatctgcataatccaacacccattgtccctgtccgtgcagagccatcaaatacatattgatcaaagctttgcatcgctttggactgaagtagcgatgacgcttatgggggaatacgctttcctccgggatcgaattattgaagtggcctgttccactcagggctattatgcagtttgccaagccaatctttttgtccaaagctgtgaacaggcgagcaagttgagcatccaagcgacggtacgtgtcgaccatctcggcctgatgctcactctgatgtttggcagggtatcttcctgcataataagtgagcgatagcagattgggctgtttggcaagttccaatcctccatactcgatcagtcggagagccaaagtcgtgacttcttcattgatcggagcagattgtttgaaaagactgatgttggaatgactgaatttgtgagaaaaggcaacgggatctccacccacaggcaaagattggggcgaggacataggagtccatacaacactgcttattttagaagagggagagtcggccgaggagttgaacttatcgatgtaccaagggaaatctttgtagtaggtagtcgtagcccacatccccttacgatcttcgagccagaatgcaccatttccagactgacctgcagctacgattgctgctacggcattcggtgctatcgcataaaccttgctccttccatccgttgcactccgtagttcatcgccgatagtgccggaagtgagcttgagaggagacagatgttcagatgtataattgcctaagaagtttttgtcttccaaaatggataccgacttgttcttttctctgtcgaatacagtactgcctgtaatactgtgacgattaggataggtgccggtatatatacctgcaatagccgatgcttcgtctaccccatcgaatccgaagtctacgttgctaaaaacaagtccatcctgcagcagatgattaaatccacctgtgccatattgtgagcggcaaaacgagaggagatcacctctcaactggtcaatggtaattaccaccaccagcttgggatgaaccgattgcccctgtactgtaacattccctatagtcaatacggccaaaagggtcgttacaagtcgtttcaccgaacgttctttctccatctatttaccaatatccagcgagcggaaagcaaccatagagcaatgccggccacatagagcgggagcactacttgttgcggcaaaaaccatattgccaaaccgatcaaacttagctctgcaaagttaataaaatgatagacaaagcctgctcggtgaaagagcggtaccacagtcagaggcaacccgataagcagatgaaggggatgaagcaggaaaagattgtaattcgggttggtatgcggatgttctgagaaaaatgacagaatgaaaataacacatcccgataaccccataatggctaataagatagagtcatatacatagcatatatccttgcgacgaacatcccaaacagctactgcaatagaaactatcagcaaagctatagaagccaataaaggtgtaggccagccctcctccgcaggttccatactggccggcttagccggaaaccactctttggtatccctgatgagtggcgttgatcgaccattgggatagagtagagtggtacgtggtagcagatccaacattctattcggcaggaataactgctcctccggattggcataggtatctgttttcgccccgagagccagatcgatgccgaacttgacccaaggggcatcggtacagcattcatcgatcagctgtctccactttctctcctcaccctcatgagggatttgcaaggtagctcctgtggtttcttttatgatctcgataaggcgggtagcacagttgtcataaaagatattatagcggtatcgtttattctcggggcgaatattccatgccaaatacctctcagctttttcgatctcttcctgtgtgagattcaatactaattccacgattcctcttccgctccgaaggtattcttccacataataggatgtataaagagcttcaacggtaataatccgtttcgcctcgtacaaatcgaagcatgaaattaggttcgttataatcgaacatgccataattgtaagcaatatccgtcccttgtacgggattgagaatcctgaatgcgacatgaccgtagcgagtgtataccgcttctgtagaaggagaagagatcaagaggctcatctgcagaccttgatctttcgtctccgtgctaactgtctgtgcattggccagaagtccgctggccaataagacaatcaagatggcggagaatagtccggccgatactttcagtgtgcttagatatttttttgccattgtgaattaccaatatgagagtactttgtattattttcc

SEQ ID NO: 923 - DNA (genomic), 3805 bp, PORYPHYROMONAS GINGIVALIS; double-stranded, circular
  misc_feature 1...3805
  hypothetical: NO
  anti-sense: UNKNOWN
acaagcatgaggctcagcaaccccggcaactggacattaattcactcaaataatcgacagctatggactatatcaatgcaataggccggcgtaaggctgctgtagctcgtgtttatctgagcgaaggctccggcaagatcgtgatcaacaagcgcgaaatcgaacagtatttcccgtcttcaatcttgcagtatatcgttaagcagccacttctcaagctcgatgttgctgcgaaatacgatatcaagatcaatctgcgtggaggtggtttcaaaggtcagagcgaggctgctcgcttggctatcgcccgtgcactggtcaagatcaatccggacgacaaacccgctttgcgttcagaaggcttcatcactcgcgatcctcgcgtggtagaacgtaagaaaccgggacgtcccaaagctcgcaagagattccaattcagtaagcgttaatgtccttagaggatatttctcgcgtttagtatctaaatccatcggattgcattcgggggtaattcatttcttttcgagtctgctctaccggtttggattgcaaacagtaatcattacaaagaacgtaaacgaaaatgtcaagaatttcttttgatcaattattggaagccggtgctcacttcggacacctcaagagaaagtggaatccggctatggctccgtatatctttatggagcgcaacgatattcatattatcgacctgcacaaaacagttgctaaagtagacgaagcagccgaagttattaagggtatggccaaaaatggcaagaagattctcttcgttgccacgaagaagcaggccaaagaacctatcgccgaattggccaaatcagtgggaatgccctatgtggtagaacgctggccgggcggtatgctcaccaacttccccaccatccgcaaggcggtgaagaagatgacccagattgacaaaatgacggctgacggcacatttgataatctttccaagcgcgaaaagctgcaaatcactcgccaacgtgccaaattggagaagacgctcggttctatcgccgatatgaaccgtctgccttctgccctgttcgtggtggacgtgatgaaagagcacatcgccgtacgcgaggccaaccgtcttggcatccccgtattcgcaatggtggataccaacagcgatccttcgcttatcgactatgtgatcccctctaacgatgatgccctgaaggctatcgaactgatcgtaggcacgatgtgccaggctatcaacgaaggtctgatggagcgtaaggccgaaaagcccgaagaggaggagacggaagaagcagctccccgtcgcgaacgtcgcgctcgctcaggagctcgtcgctctcgtcagaatgagaacgaagctacggcagaagctgccacagaggtagcagaagctccggaagccgaagaggcggaataaacagcacacatggaattatgagctatgggttataatccatgagtggcctcagcatgcaggttccaaactcaggggttatgactcatggctcataacttttttacagaactaataacccattcattatagaacaaaccaatggctgtaacaattcaagacattgccaagctgcgtaagatgagcggtgccggcatgatggactgtaagaatgcgctcgaagagtccaacaacgacttcgagaaagcaatggaaatcattcgcaagaagggacaagcagtagctgccaagcgttcggacagagaagcggcggaaggctgcgtactctcagccgacaaagacggatttgccgctatcgtagctctcaagtgcgagacttgatttcgtggcaaagaatgccgaatttatcgagcttacacaaaatatcctcaatacttgcttatggacaagaagccggccaacaaagaagagctgctcgcccttcctctggctgacggacgcaccatagccgaccacattaccgatcgtatcggtgtgacgggtgagaagatggaattgggtgcttacgaatacatcagcggtgcctccagcatttcttatatccacccgggcaacaagctggctaccgtggctgcattcaacgaagctatcgagcaccagatggctcgtgacatagccatgcagattgcagctatgaaccccgtggcagtactgcccgagcaggtcgatcagcacatcatcgatcaggaattgcagatcgctcgcgaaaaggctctcgaagccggcaagccggagaatctgctggatcgtatcgctcaaggtgctttgcagaagtactacaaggaaaacacactcttgcagcaggagttcgtgaaggacagcaagctgaccatcgaacaatacctccataccggtagcaagacgctgactgtagtaggcttcaagcgtttcacgctcaacgccgactgatcaaatagctgcgcgaccaagtagctttcgtcattcccgaacggctatgctcatttcacagggcatagccgtttttttgtgcaacgggcagccttacataaatgatgaaagatgtatggtttatcccgtgcgacagtcttattcgatgattagtccatttccattcaactgttccaagagccacgcgacagatctttttggtcgggaaaacgtcattgttcgccgggaaatctgtatttcggctctgcaatgcagattgtccggcgtgcaaacttgcaaaattcatggtcttgaaattctatacagtgatctccataattatctttgttcgaggaaagcatacaggctcgaccacactcagaaaagataagtaatggactacaaactcacttctcgattcaagcccacgggcgaccagccggaagccattcgccaactcgtacagggcatcaacgaagggatgccggctcagacgctgctcggcgtaacgggttcgggcaaaacttttacggtggctaacgtggtggcggcggtcaatcgtccgacccttgtcctgagtcacaacaagaccttggcagcacagctatacggagagttcaaagccttcttccccgagaatgcggtggagtatttcgtcagctactacgactactatcagcccgaggcctacctccccgtcacagacacctatatcgaaaaggacatggccatcaacgcggagatcgaaaaactgcgattgagggccacggcttcgctcctgtcagggcggaaagatgtgcttgtggtcagctccgtatcctgtctctacggtatggccaatcctgaagctttttccgaaaaggtgatcagcctgcacacgggacaaagggcagacagggatcattttatccgcctgctggtagagagctactacacgaacaataaagtagagttcgagagcggcaacttccgtgtcaaaggcgacagcgtggacatattccccgccgtagaaggttatgacggcgtggcatacagggtggagttttgggatggagaggtcgagcggctgagtaccttcgatccgcgaacgggacgggaatacggcctgctgtcggagctgaagatatatccggccaatctcttcgtgacgactaaggagcaggtggatcgggcagtagggaaaatcgatgtggatctgggcgcacaggtcgattttctgaaagaaatcggcaaaccatatgaagccaaacgcttgtatgagcgggtcacgtatgacttggaaatgatccgtgagttgggttattgttccggtatagagaactattcgcgctacttcgacggccgtgacgcgggcgaacgtcctttctgtctgttggattatttcccggaggatttcctgttggtcatagacgaaagccatgtaacgatacc

SEQ ID NO: 924 - DNA (genomic), 3168 bp, PORYPHYROMONAS GINGIVALIS; double-stranded, circular
  misc_feature 1...3168
  hypothetical: NO
  anti-sense: UNKNOWN
cagcctctcttataaagtggatcatacgcccaaaagcgcgtatgatccgtagtagtttttagttttctgaaagcttttctttcaaagcggccagctcgccgaggtctccgagagtggctttctctacagcctgtgcaggattggcagcttcggcagcagcttctttctgagccgctttggcttcagccttacgctctgcattggcttcacgctgagccattttctgctcatcttcgaatacacggctatgagatacaatgattcgcttggcatccttattgaactcaataaccttgaaaggtaacttctcttcgagtacagcctgtgagccatcttccttcaccatgtgcttcggagtggcaaaaccttccacaccgtaaggcagagaaacgacagcacccttgtccatcacttcgattaccgttccttcgtggatagatcctacagtgaataccgtctcgaatacatcccaaggattctcttccaactgtttgtgacccaagctgagacgacggttttccttgtcgatctcgattacctgaacttcgatatcagcacctacttccgtaaactcgctggggtgtttgatcttcttcgtccaagaaaggtcggaaatatggataaggccatctacgccctcttcgatctcaacgaatacaccgaaattggtgaagttgcgaacacgagcatggtgacgagagcctacagggaaacgagtttcgatatcagcccaaggatccggcttgagttgcttcagaccgagcgacattttgcgttcttcgcggtcgagcgtcaggatcacggcttccacttcgtcgcctacatgcaggaagtcctgagcagaacgcaagtgctgtgtccatgacatttcgcttacgtggataagaccctcaacgccctgtgcaatctcaacgaaagcaccgtaatctgccatcaccacaactttacccttcaccttatcgcctaccttaagctcgctgtcgagagcatcccaaggatgaggcatcagctgtttgagtccgagagcgatacgcttgcgatcttcatcaaagtcgaggataacgacattgatcttctgatccagctgtacgatttcttccggatgagccacacgaccccatgaaaggtcagtgatatggataagaccatccactccaccgaggtcgataaatactccgtaagaagtaatattcttgacgataccttcgagtacctgccctttttcgagcttgccgatgatttctttcttctgttgttcgagctctgcttcgatgagcaccttgtgggaaacaactacattcttatattcttgattgattttcacaatcttgaactccatcgtcttctcaacgaatgcatcgtagtcgcgaatggggcgcacgtcgatctgtgatcccgggaggaaagcctcgataccgaatacatcgacgatcataccacccttggtacgacacttcacatagccctttacgatttcgtctttttcgagagcctcgttcacgcgctcccaagagcgagcggcacgagccttgcggtgagacaagacgagctggcccttcttatcttcctgattctcgatataaacttccacttcgtctcccactttgagttcgggattgtagcggaattctgttgcaggtaccacaccttccgatttgtaccctacattgataaccacttcacgcttgttgatagcagttaccctacccattaccacttccttttccttgatggtattgagcgttttgtcataagcagcttcctgctcctgacgactcacggcagcatggacgccaccggcctcaaactcttcccagttgaaatcctctctgggctgaatgttctttaagttttccatttgttttttaatcgtcttgttgctaatagattggacattatatggtcatatctctcaaaagcacggcaaagttacaataacttttcgttactctcttcattgtgatcaacctgcagattccccccaccggtgcaacattaagcaagcgacctcaggattgactcccaagagtcaaccgaaatcaggaaacgacactatttgaaattacaatgttgcaatatcgatcttggcgtaaaactgatcggaaacggtccgatgtttcttcacaattactgctttttttgacctcctcaagcctcattttttcagtacacgtcacgtcagtcgtcagtataaaaaagtgacgcgtgcctttcctgaaaaggcgcgcgagaattttcccgttttggcgcgagatgtttttcgttctggcgcgggaattatttatttctcgcgccaaaacaaaaaagtttacgcaccacgttttcaggggtgataagccggaaattttgggcgcgtaaactaaaagcgaattatgatgagataagggtacccttgtgggggactcacgttgatgatgacgattcggccggctatatgggttatacctgtcgcaggttgatcaccgttttcttgccgttgcgatccgtgagcagcgataagtctttcaagcgcgttacatacatacggtacttccccagtttcttattccggaaataaccggcatagccgaatagacctccattgccgaatgtgcgaagcgagcttttgagatcgtccttgccgatgggcactatttccatttccttcctgtcgaagaccaattgcccccatatttgcttgacgattatttgttcctctgtcacctccgtatagcgtggaatgatagctatgctccatcctacagcaggaagaatgataacccacaaggcagctaccaaaacccacatgccgttgtaccaagccggtattagagcaaagactatcaataaaataatgaggatagagaagattcgctgccggatactgaggggatagtattgccgtcctgttttcatgagagttttatttgagggatgatggattgttcttcttctctgtcgccttggaagataaggcacaatcggatttggatgaacaaccggagcatgctccacccgaatcttttcgcttccagagacgaaccaaacgataaataatcaggccgaggacgacaatacccgttatggctgtgaggatattctgtatcatatctatgggcttatacggttcagaagaaaagtattcctatccggtagattaggaatgatacgatcggggatcctctagag

SEQ ID NO: 925 - DNA (genomic), 629 bp, PORYPHYROMONAS GINGIVALIS; double-stranded, circular
  misc_feature 1...629
  hypothetical: NO
  anti-sense: UNKNOWN
cgccaaaccggtcataaagaagaggaagaaagtgatccagaagctttgtgcacctttctccttgcgcatcagttggaaagaaataccgatcagccccaaaagcaacggaagcatgtagtacacattgtgtccgcgattcttggtcataaagtccggcatgtcatccgtaggaccgataagaatcttgtcaatgaagggaatacccgtcacggcattgccacgcaatagtcctccgtcgccttgcaggtcattctgacggccggaaaaattccaaaggaaataacgccagtacatataattgacctgataattgaagaagaatttcaggttctctccgaatgtaggcatactggtatccgtttcggatcgccccatccagatattatagctttgcggatgtccatcggtagtggaatagacacgtgggaaaagcatcatggaaccatctccataatcgtattcgcgttgtgtatagagcgtttcgtaacgatccttatctgtaggatttaccttgggcgaaggccctgttacttctgccatccttcaaccgacaggttgggatgcaaaggaaggcccgtagatcacgggtacttcgtattgttcgcgagcaaggtagctacaagccgaaa

SEQ ID NO: 926 - DNA (genomic), 4174 bp, PORYPHYROMONAS GINGIVALIS; double-stranded, circular
  misc_feature 1...4174
  hypothetical: NO
  anti-sense: UNKNOWN
tcttgctccctgcacgatgcaggacgcgattgtcagctgattctgctcccatcaatgcgctaactatcagctgtttgcaactattttataggactttcattgaagtcttttgccgcagagctgattcttaagtgtttttcagattacttgaggtttgcagagagatcgcatgaagctctcctttcttcgtcaaatcaatgcttgtgtctgtcttgatcgatatgagggggtggaagggttattgtgcaaaagtctcggtctgtaaaatcaattctatcaactcgacacccatcaaacgaaatgcaatgaaatatgcacttcatcccctgtatgaatcaggttttattcatcttctttattgaaaagcaagaatcaaaattcgatcgccgtctctacttgatcattcaagttcttctttctacggcaatggacaatcgatcatcaagaaaaaggctgcttgaaaatgagtcggaatattttagcaggtagctctttctttgttcttgcatgccgaaaatgacagaggttggcaagcaaaacccgtgcgacactgtaaattaaatacttacctttgcaatagtgacattaaaaacaataaagcacagaaacaaatagcaaatctgaaatgaaagaatttttcaaaatgtttttcgcctcgatcctcggggttataacggcaggaatcatcttgttctgtatctttctatttatctttttcggcatcgtagccggtattgcctccaaggcaacgggaggaaccattccgaagatcgaagcaaactccatcctacatatagacaattcttctttccctgagatcgtatcggccaatccctggagcatgctcacaggcaaagacgagtccgtatcgctctcacaggcagtcgaagccatcggccaagccaaaaataatcccaacataaccggtatcttcctcgatctggacaacctttccgtcggtatggcatcggcagaggaattgcgtcgcgcgttgcaggatttcaagatgtcgggcaagttcgtcgtatcctatgccgacagatacacccaaaagggttactacctctccagtattgcagacaaactctacctcaatccgaaaggaatgttggggcttatcgggattgcgacccaaacaatgttctacaaagatgccctcgacaaattcggcgtgaagatggagatcttcaaggtaggcacctacaaggcagccgtagagccattcatgctcaacaggatgagcgatgccaatcgcgaacaaatcaccacatacataaacgggctttgggacaagatcacatccgatattgcagagtcgcgcaagacggcaatggattccgtgaaaatgtttgccgacaaaggcgaaatgttcggtcttgccgagaaagcggtggagatgaagctcgtggatgagctggcttaccgtaccgatgtggagaaagaactcaaaaagatgtcccaacgcggagagaaagatgaacttcggttcgtatcgctttctcaggttctggccaatggcccgatgaacaaaacgaaaggcagtcggatcgccgttctctttgccgaaggtgaaataacggaagaaataataaagaagccgttcgacactgacggtagctccatcacacaagaactcgccaaagaaatcaaggcagcagccgatgacgatgatatcaaagccgtagtacttcgtgtcaattctccgggaggtagtgctttcacttccgaacagatatggaagcaggtagccgatctcaaggccaaaaagcctatcgtggtctccatgggcgacgtagcagcctcgggcggatactacatagcctgcgcagccaacagtatcgtggcagagcatacgactctgaccggctccatcggcatattcggcatgttcccgaacttcgcgggcgtagccaagaagataggagtgaatatggacgtcgtacagacatccaagtatgcagacttgggcaacaccttcgctccgatgacggtcgaagatcgtgccctcatccaacgctacatagagcagggctacgacctcttcctcactcgcgtatcggaaggccgcaaccgcaccaaggcacagatcgacagcatcgctcaaggccgtgtatggctcggcgacaaagctcttgcactcggtttggtggatgagcttggaggtttggacacagctatcaaacgggccgcgaagctggctcagctcggtggcaactacagcatagagtatggcaagaccaagcgcaacttcttcgaagagttgctctcctcatcagcagcggatatgaagtctgccatcctgagtaccattctctccgatccggaaatagaagttctgcgcgaactccgctccatgccgccccgtccttcgggcatacaggcacgtctcccctattacttcatgccgtactgataaatgagacaaccgtaattgctgaagagatggatgcgccccgtatcaacaagtggctcaaaccgctttccgccctctacggggtgggcgtgaggttgcgcaactacctcttcgacaagaacgtcctgatttcgaactctttcgacatccctatcgtctgtgtaggcaatatcaccatcggcggcaccggtaagacaccccacgtagaatacctgattcggctcctgcatccacgctatcgtgtagcagtggttagccgcggctataagcggaaaaccaaagggatgatcgttgcaaccgaaggatcgactgcatgggatataggagacgaacctcgtcagatcaaacgaaaatatccggacctgaccgtcatcgtggatgctgaccggagcagagccatcggctatctatgcgatctggcagaagagcaaaggccacagctcatcgttctggacgatggcttccaacaccgtaaggtgaaagcagacctgaacatagtactcacagactacaaccgtattctgaccaaagactatctgcttccggccggtcgtctgagagaacctgccggctctatacagcgtgccgatatggtaatcctgaccaaatgccccgatgatcttgctcccatagatcttagagcagccaaacgcgacttggccttatacccgcatcagaagctgttcttctccaaatttctgtacggacagggactgaagcctttgttttccgatcagtctccttcggcagaagtacgctctgcgctggctatcgccggaatagcaagtccgaaactgttcttccgagaaatacgcacccgattcccctccggaacggatcgcatctatccggatcatcatgagtttaccgacagagagatctgtttgctcatccaagattggcacgaactgcatcggaaagatgccaatgccatagtggtatgtaccgagaaagatgccatgcgactggccctacgacaatcttcttttccgcaagagatgcaggaaagattttattacctgccggtggaagtaaaactgatgttcgatcaggaaaaagtatttgtcgataggctattgggagtcatccaacacaaaaaataagcgcaatgaaacgtaccgaaatatcttctctgggtgagttcggactcatccggcacctcaccgattgtgtccgactgaaaaatcccggtaccctcaaaggcataggggacgatgctgccgtcatctcattcgatgaaggcatgaaagcacttgtcactaccgatatgctcctcgaaggaatccacttcgacctcacttatacccctctcaaacatttgggatacaaaagtgcgatagtaaacttctccgacatatatgccatgaacggcacaccacggcagctgacggtttccataggtgtatcggcacgattctcggtagaggatatcgaacagatctatcagggtatcctcacggcctgcgatgcctacggcgtagacctcgtaggaggcgatacttcggcgtcgctcaccggattgtgtctgagcctgacctgcatcggggaggcacgagaagaggaaatagtgtatcgcagtggagccaaaccgaccgatctgatctgcgtgagcggagacctcggcgcagcctatatgggactccagctactggagcgtgagaaagcggtctatcagggagaaaaagactttgcaccggatttcgccggtcatgagtacatactcgaaagacagctgaaacccgaagcgcgcaaagacattgt

SEQ ID NO: 927 - DNA (genomic), 925 bp, PORYPHYROMONAS GINGIVALIS; double-stranded, circular
  misc_feature 1...925
  hypothetical: NO
  anti-sense: UNKNOWN
cctctggcgtaccttcccgatcatcagggaatacgtaccccacagtacggccagctctgtatgggaagcccgccttgccttcgaagagatgggggcaccggctcatacattcagtccggcttatacgccggaggagtttccggagatactgcgttatagcagtcacgtcacattcaactctctcagccagtactacctgctttcgcccatggtgaagaacgtaggcgtatcgctcggactcagaatcaaccccgaatactcggccgtggagaccgcgctctacaatccttgtgcaccgggttcgcgattcggtgtatcggcttccgaattgggcgacaccctgccggagggtatcgagggtctgcacttccatacgctttgcgagagcaccggctacgaactggagaagaccctcaagatcattgaggatcgcttcgcttccgtgctggagcaagcgcattggctcaatatgggcggcggccacctgatgacccgtcgggactatgacgtggagcaccttgtgcaggtgctgaacgacttctcccgccgccatccccatctgcatcttatcatggagccgggcagtgctttcggctggcagacggggtttctcaagagcacggtggtggacatcgtagagcatcaaggcattgccactgctatcgtggatgtgtccttcacctgccacatgccggactgtctggagatgccttacaaacccgtcattcgtggagcgcatcaggagccggtacccggcctgcccacatacaggataggcggatgcagctgtctgagcggcgacttcatcggtgactggagtttcgatcggccgttgcaggtgggcgatgaactgatattcgaagacatgctccactacacgacggtgaagacgaccatgttcaacggtgcacgccatccggacatc

SEQ ID NO: 928 - DNA (genomic), 1098 bp, PORYPHYROMONAS GINGIVALIS; double-stranded, circular
  misc_feature 1...1098
  hypothetical: NO
  anti-sense: UNKNOWN
gggcgtcatggaatatatgatagcctcgatgctcttgaaggcatcgtcgtctatgtcgatatccttgatggcctttcccactcccgggatcatggatgcaagctctttgaggttacccatctttttgatctgatgtatctgggcaaggaagtcattgaagtcgaactgattcttggctattttctcctccagtttgcgagcttcccgttcgtcgtattgctcctgagcacgctccacaagcgatacgatgtcccccatgccaaggatacggtcggccatacgctcggggtgaaaagcatcgattgcttccatcttctcccccgtaccgacgaacttgatgggcttgtttacgaccgaacggatcgagagggcggcaccgccccgggtatctccatcgagcttggtaaggacaacaccgtcgaaatccaagcgtgtattgaactccttggctgtattcacggcgtcctgaccggtcatcgagtccaccacgaaaaggacttcgttcggctggatggcagccttgatggcctctatctcgcgcatcatttcttcgtcgatggccaaacgacccgcggtgtcgatgatgacaacgtcgttccccttggtcttggcttcggctatggcgtgtcgggctatctcgaccggctttttgctgtccggttcgctgtagacgggtaccccgagctgctcgccgaggatcatcagctgctggatagccgcagggcgatacacgtcgcaggcaacgagcagaggtcgtttgccctgcttggacttgagcatattggccagtttgccggagaaggtggtcttacccgaaccttgcaatccggacatcaggattactgccggactgcctttgagattaatatccacagaatgtccgcccatcagagcagccaattcgtcatgaacgatcttcaccatcagttcgcccggacggacggaggtcagcacgttttggccgatggctttttccttcaccaagtccgtaaactgcttggcaacgacatagttcacgtcggcatccaaaagggcacgacgtacatctttgagagtttcggctacattgatctcggtaattctcccctcacctttgag

SEQ ID NO: 929 - DNA (genomic), 1745 bp, PORYPHYROMONAS GINGIVALIS; double-stranded, circular
  misc_feature 1...1745
  hypothetical: NO
  anti-sense: UNKNOWN
cgccaacggacattcaatagaaatgaaaggagtagatctctttaactttgagaatggttttataaagaaagtctggctcttctctgagcgaattgaagaggaagaccgtttttggacggcattggcacaaggttgttaatgaaagagaatccttttgagattgccattatacgctgaaaaaagagaatatgaagtaggtagtggcaataaatccattagaaaaagcagacagtagaaattacttttcttactgcctgcttttctttaattatatcgcttgcccaaggtatagcaaacaatcaaaggagaagatgaagagttctttcccgaaagtctgtcgattatccacctccgcaaagtctttgcctgtggcgtggcaatacgaaacgatagcatcgttatcatttcaataccatacaaatcaataaatccttgtccagattggattgttctcattgcttccgtttccatcaggagaccctccttgaatatcgttttgatttgcacgctcaccttgccagagaaggctccgaacaggtcggctatctcacaagccgacatccaaacaggagttgacgggatatgtacatttcccttcccatctatggttatagttcctcttttcatagttgtttagtattcattgttctttcgtctttccatcagcctgtccatatcctctgagattttcttctccgaaatcttcgcatagttctgcgtgctggtaatggaagcatgtcccatcatcttggcaatgctttccgtacatataccttccgagattaagaacgatccgaagctatgccttgcttgatggtaggacaggttctccttgcgtccgatgatgacacccagttcatgtatttcaaaccacatcatatccctgcttggcaaagggaagacgggttgtgtgtcatctgtcgtgttgtatagattgataatctgctcggctatcggatgcaggggaatgaatgattctactttcgtcttcctgcggttaatccgtatataacgccgtccctcggccgtctttcctatgtggtgcggatatagcaattgcgtatcaacataggcaagccccgtaaaacaggagaagatgaaagtccgtcgagccagttctttcaacgggtcgttctgtggcaatttaagttccaacaactgtttcagttccgctttgctgatgtgcatacgcttggcagggggcttcttctcatattcgacttcttctaatggattggctcggataatctcatggtcaacggcaaggtaaaccaatcggttcagccaacaaaggcaatggttggtctgcgatgctccgaagtttttgtatcgtttcagataaaccttgtattcccgtccgaactcctcggtgatgtccaagaaagcaatgtcgctcatgccttttgactccaaaaactctcgaatataactttggtaatatcttgaacttctgtatgtggagtttgagcctatttcgttagctcttactgcaagacgttctcgctccctttctcccatctggagtaaatgaatgggaactacgacatgtcccgcaatttcatttttcaacagttccgcactgacaacaccatatctcttaaggagatcctcataaagccgttccgcatcactgcggaatttcttcagacggttgtttgccgtgcatctgaggtctctgcatttttggcgttccattggtggggttgcaggaaatgccgtggtaatgacgtgttctttccgtcatg

SEQ ID NO: 930 - DNA (genomic), 1127 bp, PORYPHYROMONAS GINGIVALIS; double-stranded, circular
  misc_feature 1...1127
  hypothetical: NO
  anti-sense: UNKNOWN
gtagctcgaatcaaagctgcaactgcacatctaaaagaattgaagatcggcattatgggctgtatcgtcaatggccgggtgaaatggccgatgccgactatggctacgtagggccgggtccgggacgaatcgatctgtataaccagaagatatgtgttcgtcgtggtattcctcaggagcaggccgtacaacagcttatcgaactcatcaaagaaaacggagactggaaagagcgttagtttttcggaaggactatttttctcagttgatcactttcctctcagagacccaagcaatgaaaatcaaaattatcaatcgctcgcatcatcccttgccgacatatgcgacttcggcatctgccggtatggatctgcgtgcatccatcgaagagcctatcacgttgttgccactcgaacgtcgtctcattccaacaggcctcttcatcgaactcccggtaggctatgaagcacagatccgcccccgaagcggactggctctccgacacggtattacgctggtcaatagcccagggactatcgatgccgattatcgcggtgagatagggattattatgatcaatctctcgaatactccttttaccatagcagatggcgaacggatttgccagcttgttatcgccagacatgaacaggccgaatgggtgcttacagacgaattggccgatacggaacgaggtgcaggcggatttggtcatacgggcaaagaataattttcaatctcccttcaactaccacagatgcggatccattctatcattctcctgctgtttcttttagttatttctcctgtagccggaagtatatccattacagacagtacagcatctaagttcgaccgatatttctatgaaggtgtccggcagcgagaacaggagaattatgctgcagctttcgacatctttcgctattgccatcggttgaatcccaacgatgcggctctggtatcggagttgggaaaactggatatttgccattgggcgtcaggaggaaggaaccccggtatttggaacaaagcctatcggctctatccgaccaccaaggaactatggcaatatattaaggtgctgggtatgaacgccagggacgagctgacgatgctgcaggctt

SEQ ID NO: 931 - DNA (genomic), 3152 bp, PORYPHYROMONAS GINGIVALIS; double-stranded, circular
  misc_feature 1...3152
  hypothetical: NO
  anti-sense: UNKNOWN
ggcacaatgacgctcattgccgaacggttagtccccattctccgctcactgccgcagggtgtgcgtctggcggctgtttccaagttccatcccgtggaagaactcatggaggcttatgaggccggtcaaagagttttcgccgagagtcgggtacaggaactgatgagcaaagtggaagcgatgcctgatgatgtggagtggcatttcatcgggccgctacagacaaacaaggtgaagtacatcgtccctttcatctcgatgatccagagcgtatcctctctgaagttgttcgacgagatcagccgtcaggcgtcgaaagtagggcgtaccgtgccggttttattggaagtgcatatcgcatcggaggataccaaaagcggctttacgccggaggaattgccacaagttctggaggctgttttggcacgcggctccgataccggagtcaagattgccggtctgatggggatggctacatttacggacgatagggagcagattcgcagagagtttcgccggttggcatcgctgttcagagagatgaaagagcgtttcttctccgattctgctgatttttgtgagctttcgatggggatgagcggcgatttcgagctggccatcgaagaaggaagcaccatcgttcgtatcggaactacgatcttcggcgaacgacgctattgaaagagggaatgggttttgctccggaatgggaagagccggagccatgctctcgtacgttatactaccggtatcggtactaaacagtctcggatgtttgccgtcgcgaccggcaaatggattcgatgcagtttcctatctctaaattctcttttatgactattccgctaaaggtattctcgatcaatgagcttgcaggatacttggggggtaaaatgaatacgcttggagaccgggtcttgctgtgcaatgacaagcgatccctcccggctgcagctgtggctacgccgttcctgttcgaatccatgctcttttctgtttgcacgcgtggctatgcacgactattgatcgattcgagggagatcgaggtgaaggagggcgagctattggtagtcatgcctcgcaagacgatagaagtgatagaatcctcttgctttcgtgcctttcatttatgtctggacaaggagattcttgctttatcggcgatcaggatcagcggttttatctctatcatcaataagctacacagcaacgaaccgttccgtccggaacgcatggagaaagattttctgacggcaacgttggatctcatccgcaacgccctgcaaaacggggggcgtcatcaggaagaaattgtcatctatctgatcagctctctctttctctttcttgacgatatgattgccgacgaggtcgagaaggactgcaagcacaccaggtcggagactatttgccgcgactttctgctcctcgtctccgagcatcacaaagagcagcatacggtcaagttctatgcagacaggctgtgcctcagctccaaacatttggcactgacgataaagaccgtcatgggacagtctgcctccaaagtcatcaacagcttcatcatccagcaggccaagtccttgctgcgctatacggataagacggtccaggagatcggctatgagctgaacttctccacccagtcgtttttcggcaagtatttcaagcagcacaccggtatgagtccgggcgaatatcgcagtcaggaagctcgaaatagacagtccgaagagagctgacgtgcggctatctgatgatattggaggggaattggttagtcgataatatccggaaaagaacacggggctgtacccggatagttccttcggtacagccccgtgagggagtaatgaaagatccgatcggatctcgtagaagtcttatgcgtttaccttagccatgtaggcgatgagatcgagtactttgttggagtatccgatttcgttgtcgtaccatgaaacgatcttcacaaaagtatccgtaagtgcgataccggccttggcatcgaatacggaagtacgggtttcgccgatgaagtcggaggaaaccacttcttcgtccgtgtagcccaaaatgcctttgagttcgccttccgaagctttcttcatggcagcacaaatatcttcgtatttagccggtttcgccaactggcatgtcaggtctactaccgatacgtccagtgtcggcacacggaatgacatacccgtcagtttgccgttcagttcggggatcaccttgcctactgctttggctgcaccggtggaagaggggatgatattgccgcctgctgctctaccgccgcgccagtcttttgcagaggggccgtccactgtcttctgcgtagctgtggtggcatgtaccgtggtcatgagacctcctaccatgccccagttgtcattcagtaccttggcaatgggtgccagacagttggtggtacaagaagcgttggaaacgatcttcgtgccttttacgtacttatccgtattcactccgcatacgaacataggcgtgtcgtctttagagggagccgacataactacatacttggcaccggcagcaaggtgtgcttcggatttttctttcgtgaggaaaagaccggtggattccactacgtattccactccgacttgatcccatttcagatcggcagggttcttctcagctgtaactcgaatggctttcccgtttactatcagctgaccatctttgacttcgactgtcccattgaaacgaccgtgtacactgtcgtacttgagcatgtacgccatatattccacatcgatcaggtcgttgatggctacaatttcaatgtcgcttctgttttgtgtttgtgctgcgcggaataccaagcggccgatacggccaaagccgttaatacctactttcgtcataactaagtgcttatattttaatgttaaccattattgttttgtccggaatactttgtttttcccccgaaaaggatccgcagagattcttcccgatagacagcgttccaatgaccttgctgcaaaagtaaggaagataatccacaaacggctgattttcttgcacaaaaacatttttctcgcaccacaaagctactccattctcggacattcgtaagcaagccgtatcgtccgtcgatcgttcgctattccttgatgaga

SEQ ID NO: 932 - DNA (genomic), 756 bp, PORYPHYROMONAS GINGIVALIS; double-stranded, circular
  misc_feature 1...756
  hypothetical: NO
  anti-sense: UNKNOWN
ggtacccgccttgcccagagttccggtatggatgtcgatacgtccgtagcagtcgaactgttctgccacgccacgtccggtagcacccaccacgccggcagagtggcactcgtccaccatcaccatggcatcgtatttctctgccaaatcgcatatcttatccatgggagccacattgccatccatagagaatacgccatccgttacgatgatgcgatagcgttgggcctgtgcttctttcaggacgcgctcgaggtcttccatgttggcattctcgtagcgataacgtttggctttgcagagtcgaacgccgtcgatgatggaggcatggttcagagcatcgctgatgatggcgtcttcttctccaaagagcggttcgaatacaccgccgttggcatcgaagcatgccgcatagaggatagtatcttcggtgtggaagtattcggcaatggctttctccaattctttgtggatgtcttgcgttccgcaaatgaagcgtacggagctcatcccgaatccacgctcatccatcgcatccttggcagcctgtatcagccgagggtgatcggacagaccgagatagttgttggcacaaaagttcaatacctcttggccttcgtttacgcggatgtcagcacgctggggggtgatgatgatccgttctttcttgtacagcccggcttcttcgatactcttgagttcggcagccaagtagtctttcattcctttgtacatagcactggagttttttaggtg

SEQ ID NO: 933 - DNA (genomic), 1666 bp, PORYPHYROMONAS GINGIVALIS; double-stranded, circular
  misc_feature 1...1666
  hypothetical: NO
  anti-sense: UNKNOWN
gaaaccaattcgggaatcatcaacggttcagactggtatgtaattcgcggaagtcgtcaggacaatgcaaattatttccatcgtctgcgagaaattacccttgaaatcagcaacacgaagttggtgccggcctctcaacttccaaagtattggaatctgaacaaagaatctctgcttgctctgatcgaagaatccttatacggcatccatggtacagtgacttccgctgcgaacggacagcctctcaaatgccagatcttgatagaaaaccatgacaagcgcaactccgatgtttactccgatgctaccacaggctactacgtacgtcctatcaaagccggcacttatacggtgaaatacaaagccgagggttatcctgaggcaactcgtaccattacgatcaaggacaaagaaaccgtcatcatggacattgcattgggcaactcggttcctctgcctgtacccgatttcacagcttctcctatgaccatctcagtaggcgaaagcgtccaattccaagatcaaacgacaaataaccccacgaattgggagtggacgttcgaaggcggacagcctgccatgagtacagagcagaatccgctcgtatcctatagtcatcccggtcagtacgacgttacgctcaaagtgtggaatgcaagtggttccaacacgattacgaaagaaaaattcatcactgtcaatgccgttatgcctgtagctgaattcgtcggtaccccgacggaaatagaagagggccagacggtatctttccaaaaccaatccaccaatgccaccaactacgtatggatattcgatggcggcactcccgctaccagtgaagacgaaaacccgactgtgctttacagcaaagccggccaatacgatgtcacgctcaaggcgatcagtgcttccggtgaaacggtgaagacgaaagaaaaatacatcactgtcaagaaagctccggtccctgctccggtagccgacttcgaaggaacacctcgaaaagtaaagaaaggcgagacagttactttcaaagacttgtctacgaacaatccgacttcatggctttgggtgttcgaaggcggctctcctgccaccagcacggagcaaaacccggtggtcacctacaatgaaacaggcaagtacgatgtccagctgactgccaccaacgagggcggaagcaatgtgaagaaagcagaagactacattgaggttatcctcgatgacagtgtcgaggacatagtggcacagacgggtatcgtcattcgtccgcaaaacggaacgaagcagatcctcatagaagccaacgctgctatcaaagcgatcgttctctatgacatcaatggacgggtcgtactcaaaactactccgaatcagctccgctcgaccgtagatctttccatcctgcccgaaggaatctacaccatcaatatcaaaacggaaaaatccgctcgcacggaaaagatccatatcgggtaatccgagatctgctacacaagaaaagggatgtccggtggggcatcccttttctttttgtcatagcaagctcgtggagcattattcggtcggtgtgggataaagcagatacttcttccgcaatttgtggtacttgtcgagatccgattgccaagaggctcggatctgctcttctgtccggcctttttcg

SEQ ID NO: 934 - DNA (genomic), 2341 bp, PORYPHYROMONAS GINGIVALIS; double-stranded, circular
  misc_feature 1...2341
  hypothetical: NO
  anti-sense: UNKNOWN
caccagttgatcatattgccgtctttgtcgaagttgcggccttgatcgtcgaatccatgcgtcatctcgtgtccgatcactacgccgataccgccataattgacagcatcgtctgcatccatgttgaagaaaggcggttggaggatggctgcaggaaaacaaatttcgtttgtggtcggattgtagtaggcattgacatcctgaggattcatcagccaacgctcgcgatctacagtcttgccgaggtcagccatattgtcgtcatgcatccatttgctggcgcgtttgatatcggcataatagctgtctcccttgatttccatcttggaatagtctttccacttgtcgggataaccgatcttgatgatgaaggaattgagtttttcctgagctttcatcttcgtggagtcgcccatccatgtaagcatgttgatacgctctccgagggccgtttgcaggttcttgacgagtttgagcatgcgctcttttgcttcgggtgggaagtattgctttacataaacttcgcccagtgcttcgcccagaaagctgcttaccatacctacggaacgtttccagcgaggatgcatttcggtggttccactcagcgtcttaccgaaaaagtcgaaacgagcttgctcgaagtcatcgctcagatagcttgctgcaccgctgatcgtgccggcgaggagatagtccctcatttcgttcagatcggctttggcaaaccaagagtcgaacttcttgaagaaatcgagttgctccacatcccactcttcgagggtggtgagctgacgatcggcgaggtaagtagtccaatcaaagccttggtacttattcgtaaactccttcactgccatcttattgtagttacgatgggtatcgcgtagttcttctttgctgtagcagatttgtgccagttcggtttccatcttcatggcgttcttggcaatacgggtagctgcttcatcgtcgtagccggccagcttagcaattttgttcagataagctacatacgcctcgcgtatttgctgagacttggcatcctgcttgagatagtagtctcgattgtcaagagccaagccggtctgggtgatatggaagatgttcatctcgctattcttggcgtcggcataaacgtacgatccgaagaatgtgcttccacccatattgtccttagcagcggcatacttcaccatagcagctctgtccgcaatggcttcgatcttctgaagatcttccttcagaggggctgctccgtctttattccgtttgatgctatccatagcttgacgatagagcgtagctatacgatactcattagtgccgacttcatgctgtcctgctgcaaggttgtccacaatcaggtgtacacgctcgagggtgctgtcgtgcaggatgtcgaatgagccgtagcgactataagcaggtttgagaggattgtttttcatccaattgccgttgcagtagcgataaaagtcgtcctgcgggcgtacggatgtatccatggcactgaggtcgatggccggtaccggttcgcgcttcctgtcagtatcgttagtctgacccttattgccattgcagccggtcagcatcaatgcgccgattactgccggcgcaaggcaaagaaacttgattgtcttgttcattgtttgtgatatttggcattaaaacaatttcgttgggtattctccggcttccgttagttcgcgtagtttggctacgacaccggggcgatcgtccgaataagtgacaccgaaccatcgggctgtcgtatccagcacttccaccgaagctcgaccgctgcgaataagatcgttcacaacgaagggaatgaagaactcgctcttcggctcctgcccatgagcattcaggaagttgatgaacagttcttccgaatagtcgaagtagtcaggagtgaatccccacatattcatcgaaacgggtgcatcctctgccagcgtacatatctttccggtctcatctcggaatgagatagtaccgtctgtgcgctcgatgccggtacgctccaccacaccggtaagcaaatgtttttcatctacctggcatactccacgcgaaacgccaccgctttcgctcagggtattacccacacggtagccgaccatgcagtattcgccttgcttaccctccaaagtcatgagcttacgagccagaacttcaaaaccattgcgtccatagaaatcatccgcattgatgacggcaaaaggttcgcgaatcgcatctcgtcccatcagaacggcgtgattcgttccccaaggtttctcgcgcccttccggacaggagaatccttccggcaagcgatccaattcctgaaaaacca

SEQ ID NO: 935 - DNA (genomic), 1102 bp, PORYPHYROMONAS GINGIVALIS; double-stranded, circular
  misc_feature 1...1102
  hypothetical: NO
  anti-sense: UNKNOWN
aactcctttatgaaaaagaaagactatcggcagagtgtggaggcctataagcattcgctccgaatcaacccgaccgatgaagagactcgctacaatctggctttggccatgaagttgcttcagaaacagcaacagcaaggaggaggagacaatcaggatcagaataaggagaataatcacgacaaaaaacaaccgcaaaacaatccgaataacaataaccagggcggacagcagcagccccaaccgtccaaacaggacaatacacaaaaagatcaacagccacgacagaatgaaatgagtcgtgaaagtgctgaaaagatattgaaagcctacgaacaggacgaggagaaaacgcgcgaaaaagttgagcagatgcgtaagcagcgcatgaagcagcaaaaaggtaattccaccaagcagtggtagtccgcttctttgcgattagctgtttcaatcttgttatctccgcacagctccagaaagtaatgtgtactttagcatcctcttcataaaagcaatgactcaacggaagaacgcttcggataatttttaatgccggtgttaagaaacaaaacagatctcaataatcactgactgtactgtacgatgacaaaggtgcgatatattcttacaacccttttcctatgcctcgcttggtgtacccatgcgcaggtttctttcactgtacaagctcctgcgagtgtggcgatgggagaacaattcagagtgagttttaccctcaaagatgctaatggaacggaattcaaagctcctgccatgagcgactttgaagtcctttttggcccggccactgctacaagctcattcagttccatttccaacggcaagaccactttgtctcgaagtatcacttatacatataccctgatgcccaaatcggtcggcacctttcagatcggtccggcctccatccgtgccaacgaccgagattataagaccaagcaggtatccatcaaggtgcttccggccgataaaaaatcatcgaaaaatactaagtcttcctcttcttcctcacgagtcgatgccgtagtttgttgtccgaaccatcatcaataagaccaatgtacgagcaggaagcgat

SEQ ID NO: 936 - DNA (genomic), 1960 bp, PORYPHYROMONAS GINGIVALIS; double-stranded, circular
  misc_feature 1...1960
  hypothetical: NO
  anti-sense: UNKNOWN
ttcgttacagtcgcacagagcttggaggttcggctcgtttccgttccatggcaggtgctttcggtgctttgggcggtgacttttctgctataggacagaatccggccggcctgggcatttttcgctcttcggaagtctcggctaccattgatttctcttccatatccaatcaggcagcttggcagggatcaagtgagaccttcaataaaaacaaattgcttttcacgggtatcggttatgtcggatcatggggcaaagccaatgaagatgtaagcgtcaatttcgggctgggggcgaagcgagtgctggactacgagcgatcgtttcggatagccggaggtgagcagaagttttccgtggcggactatgtggcagctcagactcccggcaaagccaatccgtctcatttcaattataatggattggagagcagttggcttacggacttagggtataatgccggttggatagctcagcttcccggcgggtatggttttgagtccatattcaagtataaacagaatggtgagtaccagatcttcgggccttcctccacggctttcgacctgaaagagacggggcacgtatggaactatgactttggcttgggcattaacatccaagacacatggtatttgggtgcgagcatgacttatagcgatctgcaatttgacacgaacactttctatcaggagaatttttctttcaacaatggtgctatcaatgactacctgaaactcgaaaatactctctctacatcaggaagcggactgaatatcggtatcggagccatctatcgtccggctgatgctgttcggataggtttgtcctactatacgcctacatggtactggatgaagagttactatagggcttatggctcttcttattattcccaaggggtagactccaatggtcagccgcttccggagaatctctacttcatgagtagccagactcccgaatcgtataatacttatcaaatgagtagtccgggacgatttgtggctagtttggcagtcgttgctggcaaaatcggccttctcagtatggattatgaattggaatcttacggccagatcaaattaaaggatgagaacggtacggcctacgttgataataagttcatttcagaggattttggttcacgccacaccatccgtttgggaggagaactgcgtcccatatcgcgtctgagtctgcgtgccgggtattcacacacttccaatcccattaaaaatgaaaaattgaaagctttcgacggctcggcacaggtgaccgtcttccctatgggggctatgcctcattacgaacttccgggcaattcctataccgtgacaggaggcttgggttaccgtttcacgcgtaatctttcgggcgatttggctgtgatctatcgtaatgagaagagttactactatacttttggccgaatggtatcggacgacccgaatccggccaatgtgttggaagtggaatctcctgcaccggcaaaactcactcgctctaacttcagattagcaatgacaatgtcgtatcgcttctgaaaatagcttgacgtgtatttcggttctgaaaaacgtggtctgagaagatttttattttggttcgggagttgaaaaaatctcgcgccggaacgaaaagattctcgcgccattttttggagattttggtttgagattttgatctatagaaccacaactcaatcataacagcctgcaatttgacctatagaccaatagtatcctaaatgttttttagggggatgcgagttcttagtcccggagtggaataactccgggactatcattttttgattttagggggatcccccctgcctattcaaagagctgattttcgctctccggtggaggagtaaaaggctcattcagccattgcttcagatcaattttggtgaaagtgttgatccgcagggaagagaccaaattagacagacacc

SEQ ID NO: 937 - DNA (genomic), 6288 bp, PORYPHYROMONAS GINGIVALIS; double-stranded, circular
  misc_feature 1...6288
  hypothetical: NO
  anti-sense: UNKNOWN
ccatcgcgcagaaagatgccgagctggttcgcctgcagtcggaactgaacgtcgtcgaacaaaaaaagcagtccgagctaagcctcgctatcgcaggaaaagagaaagaaatcagcgatctgaaatctgccatcagagacaaagacagtgccttggagatcgccgttctcaaagagcaacagaaagcacaagaggatatcaaatccaaagaagcagagatagccctactgaaagcttcggcagagctggacaagcaaaatgcaaccattcaggagaatgcgctcaaagaccggtatgaagcccgtctgaaactgaagcaggaagaggtggactattataaagatctgaaagctcgcatgtccacgaaaatgatcggggaaaccttagagattcattgctccacccaattcaatcagatgctccgccccatgatgcccaatgcctatttcgaaaaagataatgatgcatcgggaggtacgaaaggggactttatctttcgtgatttcggcgaagatgggactgaatacgtatccatcatgttcgagatgaagaacgaagccgatgagaccgccacgaagcataagaacgaagattttctcaagaaactggataccgatcgccgggccaaaggttgcgaatttgccgtactcgtctctctgctggagccggacaacgagttgtacaacggcggtattgtggatatgtcctacagatacgataagatgtatgtgattcgtccgcagtttttcattccgatgataaccctcctggtgcagacgtccaaaaagggtctggagtacagacagcagcttgccatcgcgcagaaacaatccatcgatgtttcgaatttcgagagtcagctcgaagattttcgggaaagattcggtaaaaactatcgccttgccagcgaacgattcaaaacggctatcgacgagatagacaagtccatacagcacttgaataaaatcaaagaagccttggtcggcagcgagtacaacctccgccttgcgaacgacaaggctgaagccctcaccatcaagaaactgacacgaggcaatcccacgatgaaagcaaagttcgaagaagcccgcctcgccgaagaatgacgcactccgggatataatgccaaccgtacatctccatgtgtattataacaattttgcgcaaagccatctgaggtgtactaataaaatgtcagtcaaagaatagatattgacagaagcgaaacggatgccggcgaagcgacagagaaaaaagtaatgccggatggaaagctgccttcgtatcgaagatacggcggtgctgtcagagaaacagatccgacgggtaaactaccctctccagatagagggcatgagccggagccgaagagccggcacggctgcgatcctgcgattcgatgatgtcccgaaagtctgtgatggatagcttgcccgtccccacatggaagagcgtgccgactatggcacgtaccatattgcgcaggaatctgtccgccgtgatggaaaagacccattgaccggtctgtgcaagtggcatccatcgggcttccgttatacggcagttgttcgttttgacgtcggtatgcagtttgctgaagctcgtgaagtcgatatatcgcggaagaagagccgccgcttcattcatgcgtccgaagtcgagcttacgataggtcttcagcatcaagccttccataaaaggatctttctgctcggtcagatagtagtggtaagttcgggagatggcatcgaagcgcgcgtgggcatcggctttgacaggagccattcggtatatgacgatgtcgcgtgggaggagtttattgagcctttctgtcagggtggcagcttccgccggcgtatcgcagggaagatcggcatgtgctaccatctcgtgggcatgaactcctgcatcggttcgtcctgctccgacgaccccgacaggttggcgcacgatggtagatatggcttcctctacggtctgctgcacaccgggggcattaggctgcgtttgccagccgctgtagcgagtgccgttgtatgccagatagatgaagaagcgcgccatttattatttcttggcagtcttctttgccgatgtctttttggccggagcttttttctttcccttggccggtttcgtctctccctcttccacgtatttcagacattcttcgagggtgagtttctccgggtcttccaccgttttggggactttgtagtttttccctttgtatttgatataaacgccgaaacgccctgtgcggatctccatctccggatcttctgcaaatcctttgatcaggcttttttcctccttctcgcgtttgtcggcgatatacttgatggcatcgtcaagcgaaacggaaaggggttcggtatcttttggcaaccctacaaacttgcctgcatgcttgatataagggccgaagcgtcctacggctaccattacatccgcatcctcatattgtcccagtttcttgggcaggaggaatagttccaaagcttcctccagcgtgatggattcgatggactgtcccggctggagcgaggcaaactgcgccttgataccgttttccttatccgtgcgacctttctgcaccatcgctccgtagcgtcccatttttgctaccacagattctccggtcacaggatccgtacccagcattctttcaccgatcttctggtcgggatcgaactcgcatgcttctgccaccaacgggtggaatttgttgtagaaccgaccgatctgcttctgccattgcagttttccttcggctatttggtcaaattctttttccactttggccgtgaagttgtaatcgatcacctgagggaacgaagccacgagaaagtcgttcaccacaagccccatatcagtggggaggagcttattccggtcctgtccgttcagttccgttttgatcgtctccgttatggctttccccttgtggtattccagcaggatgtattcgcgtgttttgcccggtttgtcgccgcgtactacgtattcgcgattctgtatggtttggatagtgggggcataggtggatggcctgccgatgcccaactcctccattttacgaacgaggctggcctccgtatagcgtgccggacgctgcgtgaagctctccgttgcttttgcatgatgcagagagagcgtatcgccggctttgacagagggcaatagctgctcctcggtatttgcagagccatgttcttcgtccgaatcttcacgatagactccgaggaacccgtcgaatacgatcacctctccttgcgagctgagggtctctgcaaacttgtcggttccgattgttatcgtcgttttttcgaggatggcatccgccatctgggaagcaatggttctgcggcggatcagttgatatagcttttgctcttgcggggtgccgtctatctctgctctatgtatataagtaggacggatggcttcgtgggcttcttgtgccccttggttttggtcttgtacctgcggaaccggtagtattgctcaccccaatgttcggttatttcctttttgagtgcaccgagggccatatccgacagattcacagagtctgtacgcatataggtgataagcccttcttcgtacaacttctgagcgatacgcatggtctgtgccacaccgtagccgagttttcgggctgcttcctgctggagcgtcgaggtagtaaaaggagtggccggagaacgtttgcccggacgcttcgtaacgtctgttatatgaaagtgggcatccatacattgctccaagaaatatcgggcttcctccttcgtcttgaatcgtttctgcaattccgccgtcagcattctaccgtcgggaaggacgaactctatcgtacagcggaaggatgcttccggcacgaaagcatttatctcacgctctctctcaacgataagacgcagtgcaacggactgtacacgccctgccgaaagagaaggacgaatacgtctccataaaacgggagaaagttcgaagccgacgatacggtcgaggacgcgcctcgcctgttgggcatcgaccagattgatgtctatatctcgtggattttcgatagcagctctgatggctgtctcggtgatttcgtgaaatacaattcgcttggtctgtttgtttttcagccctaatgcttcgtacaaatgccatgcgatggcctctccttcgcgatcctcatcggaagccagccagatgaaatccgatcggtcggcttgggatttcagttccttgactaccggacgtttatcggcagggatctcgtattccggctcgtagttgttttgtatatctacactgaatttattgggcttgaggtcgcggatgtgtccgtaactcgagagtactgtataatccgaaccgaggaaacgtcctatcgttttggcttttgccggagactctacgatgactaagtttttcatccttctggttgatgggggtttgattttgcgcgcaaaggtaatgtattcgtaccgcaatacaaatgaatgagagatacttgcacattccggttccaagtgcaattgctcggcggatcattacacttaaggagacctttgaaaaaagagaaggtctctatctctatatagtcgtcccttaaaaaacctctttaagggacgactatatagaaaacaaattcattggctttttcttacgtcgaactgacgttgtaagcagattcctcacgaatttggttccggaattggccggaatgcggttcgagttttctgagattcacgagcgagaatttttccgttgtggcgcgtaaaatttttacttcccacgccaaaacgaaaaaattcccgagccacgtttttccaaacgctaaaccgccatttttacgaactgacgtgtacggaatcggagaggtcaaaaaaagcagtaatcatgtcgaaacatttgacctattccgagcgtcttcacattgtggaagaatacctcggcagccccggagcaagtatgccatcaagaagaagtacaacatcgcccagaggcttattagagaccattgcacggcattttgcgatatgaccattggtcttttcttacgtcgaactgacgtctatatacaaatgggctatgaacatggaataccatcatccgatttctaatgcaacagccctgatttacacaccttactctgtttcccctcgtatcaggtctgcttgattccttcggagtcgtgatagaccagcatttgacagtgttggcagtcgaatcggagtcgcagacgagtttcgccatgaatcaggtagtacggttctctgtacggcgattccttgtgttggagggtggggcaatagcccaaatgatagcggagacagtgcttcgaaaacataagcggaacgccttggggatgcgagtgttcgaaggcgggggcgatagatgtatatcccatttgccgatagaaggtttctgcttccttgttcgccacattggctaagaaggaaaggctctgctctccctcctgcaagctgctcgccgcaggagaaatgcgacgttgtacgaccggtttttcctcacgttcaggcatagaggaggctttctcgatgaaggattggactgcatctctccttaaccggccaatgagagaaagcgggatgaaatagtcgtgactgagccggatatcgactgatacggcttcaagcggtgtaccacctaatttggtcagattcttgcggatctgctcttcatcgaaccgtgtggcaggctcgtgagcagctgttatcgtagcctttgcagatgggtagcagtcggcctctatcgagagagagaagccgtccggaacatccgtcaaggtaagagatacgggaatgaggcgaacggccgagttgtcttgcgagagagctttctcgaaacggatgtcgtaattgcggaatacgtttgttcccgatacgatgccggcaggattgtccacttgtatgctgccgtcgggtaaaaccacattgatgcgcgtaccgctcatgttgccgtcggggtgcaggaggtaaaggccatcgccattggccagggagggcttggctcccgtattatcgggtcgcagccggatactgaccttgtcgcggtttacagctgtcacgcagccgatataggcacctttgcttttgttcgattcgggtgtgatgagggtatttgtgtcgcgcttaccacttagaaggagattagtgaagccacggttgaagctcttttcaggggcgggatggaaagcgaaagtgcagcgtcccgatgaagctctacaataacgttcggggtagcggctgatgagttcgtccaaaa

SEQ ID NO: 938 - DNA (genomic), 2083 bp, PORYPHYROMONAS GINGIVALIS; double-stranded, circular
  misc_feature 1...2083
  hypothetical: NO
  anti-sense: UNKNOWN
ggatcggtctatttcgatgtggaaaaatacaatcaagaccatcgctacggagtattgagcggtcggaacatagaagagatgatcaataatacccgcagactcgatgggcaggacgaaaagcgaaacggcgtagactttgctctctggaaggctgctcagcccgagcatatcatgcgttggccgagtccttggggtatgggattcccagggtggcactgcgaatgtacggccatggggcgcaagtatctcggtgaagagttcgatatacatggtggaggaatggacctcgtatttccccatcacgaatgtgagatagcacaggccgttgcctcacaggggcaccctatcgtgcgctattggatgcacaacaacatgataaccatcaacgggcagaaaatgggtaaaagcttgggcaacttcatcacactcgaagagttcttctccggagcgcatccgagtcttaacaaagcttattcacccatgaccatacgcttctttattctcggagcccactatcgaggcactgtagacttcagcaatgaagctctggaagcggcagagaagggtttggagcgcttgctggatgcagcagccttgctcgatggattgaagactgccgacacgacctccgtagaggttggcgatctgcgtaagcgttgctacgatgccatgaacgatgacctgaacagtccaatggtaatagcagcccttttcgatgcagcgcgcgcaattaatgctgtacacaatggacaaggtaccattacttcttccaacttagaggaactgcgtactacattccgcctcttcctgttcgacctgcttggtatgcgcgatgaaagggcgtcttcagccggtggcagcgaagccttcggcaaagcgatggatctgctcctaagtatccgagccgaagccaaagctcgtaaggattgggcgacaagcgataagatccgcgacgaactcacggctctgggatttacgataaaagatacgaaagacggtgcagagtggaaattgaattgacctctcagccataacttctctcgacttatcatctaatttctgatatacatatggcttatttctttaaaaatctcgtctttgaagggggtggtgtgaaaggcattgcctatatcggggccctcgaagtgctgcaggaagaaaagattttccccaaaatcaaacgagtagccggcacatcggccggtgccatcatggctgtgctcatcggactgggttatacaccgagtgagatcaaagagataatgtggtgcctcaatttcaagaatttcatggacgattcgtggggtatcattcaagatacgaaacggctgatcgagaagttcggttggtacaaaggcgatttcttccgcaattggcttggcgacctgatcaaggccaagaccggcaacagcgaatcgacctttgcggatttggctgcaatgaaaggagaaaacaaatttctcgacatttctctcatcggcaccaatctttctacaggcttctcagagatcttttcggcagaacatacacctcgcatctgtatagccgatgctgctcgtatctctatgtccattccgctgtttttcgctgctaagcgcaacttccgaaacgatgtatatgtggacggcggtatgctgaacaactatcccgtcaaggtgtttgatcgtaccaagtatgtaaccaagaactttacacgaacgggctactatgaacctatcaataagaagctggagaaacgccccaggaagattgccgattacgtatacaacaaagaaacattgggcttccgactcgacagcaaagagaagatagccttcttcagggacaacgcagaacctcctcatcgagatatcgacagcttctttgactataccgtgtcgctattcggcactctgctctctgctcaagacgatgtacacctgcacagtgatgactggcaacgcaccatttacatcgatacgctgggagtaaagactacggattttgccatcagcgatgcccaaaaaaaagctttgctggaatccggccgctcatacactcagtcatatttggagtggtacaataacagcgaagaaaaagtcag

SEQ ID NO: 939 - DNA (genomic), 3183 bp, PORYPHYROMONAS GINGIVALIS; double-stranded, circular
  misc_feature 1...3183
  hypothetical: NO
  anti-sense: UNKNOWN
ctgcttatacttccaaatacatcagccgtttcgtctgaaacgataccgatttttcgacatcgggaacgaccattactactacgacgacttccgcaatgaagaaatcatgcgacggatcacacagaagtgctatctgccggccaatctgcttttgaaggaaatcattgccgaacatcccgagtttcgagtagcattttctatttccggtactgctttggaacagctggagtcctattcgccggaggccttggacaccttcagagatttggccgaaacgggctgtgtagagtttctggccgaaacctacgctcattccctctcgtcgctctatgatcccgaagaattttacaatcagacgatgatccatagtcgtcggatggaagagctgttcggtgtaaaaccccgagtgctgcgcaatacagagttgatcttctccgacaacattgccacccaagtggcagaaatgggttttcaagggatgctcacggaaggagccaaacacatactcggatggaagagtccgaactatctgtacaaagccggatccgctccggagttgtccctcttgctccgcaatccgaggctgagcgatgccatcagtgccatgttcacccgctacgattggaacgaatatcccctgacggcagacaagatgatccgttggatcgaagagactcccgaagaggagcagatattcaatctcttcatgaactacgaagtcttgggatcgctccatccgcaggagtcgggtattttcgatttctttcgtgcactcccttctttggcgaaaaagagcgaaggtgtcaaattcgctacgccatcggagttgatagagtcctccagccccgtagccaagttctcctccatctaccccataagctgggtaggagaagaaaaagataccggtacgtggctgggcaatgtgctgcaacaaggagcatgcgacaaactcgaacaatggggcgaacgtgtacgtatgatcgacgatcagcgtatgctacaggactggctctatctacagagcgccgaccacttctactatatgaaaacccgtggcggagacgccggcaacttcagcccgtacgaaacgccttacgatgctttcaacaactatatgaatgtgctcagcgacttcctgcttcgcgtagaagcccgctacccttctacgatagaaaatgaagaactgaaagccttgctgactacaatcagaaatcaggataaacaaatcaaaaaattagaagagacaatcaaacgtcaaaaaacgaaaacaacatgaaaaaagtaatttttagtctggctatcatcttggccggcatattctcaatgaatgctcagagtgctatccgcaagggtgacgtttcgctcaacgtcggtatgggtatcggttctcatcacggatcggctgcatttatgcccaccgtagacctcgaaaccggtatcatcagcggtcttgccagaggcaaaggcgccattactgtaggaggtcgccttggctattacggcacggaacacaatttctctgccatcattttagccactaaattagactttcactatcagctggcttctgctgtcgatggctatttaggtcagactctgggaggctatttcggcaatgataccggctttgtctacggtattcatcttggagcgcgcttctttgttcagcgcgattttgcattgttctcagaagtatcagccggctgggctactccctttgtcatggtaggggttagtttcaggctataacggaagagtcctcttaacctttctgctaccgctttcgacatgtggatacgggtgaacttgctgaacaacatattttttcctttggcggtttattcgatttgcacgacttttgtggacggaaagctcaagatcttctgaaaaaccagagaaccatttgctattgaaattgaaatgaatccacaagaggctgcctcccggaacagttccgaaagaggcagcttctcttttttgagactgttgcacgggattttcattgaattcttttgctgcagggctgattccttgtgttttcaggaaaggtcaaatctcaagtatatgggcaccgagtaaacagaaatttccccaagcttccatcagaggtgtatacttgaggtttgcagatactgcatgaagcgctcctttcttcgtcaaatcaatgcttgtatctgtcttgatcaatatgaaggggtagagggttatattgtgcaacgatctccaagaagtatttcaggggaaagttctgcttaatctgcttgaagagtcgctctatgagccaacgtttgcgatagatttcaatgacctcccgctagtctgattctaagtcatcactaagaaagccgatgaacttacgcttaggcacatccacataggtaatgatcctggagctatgcctggttcttctccggtgcgcttcttgacaaatacggcttcttgttcttgcaggcgcatctccatctctccctgtggcgtttgaatcatcatatctgtcatatactactcgcttaaaacgaaatatcgataccaacatcaacggtgttgtaatctttccgcacaggtacaataggggcagtatcgtagatgatccgataggccccgcgtattcctatcgtaggtgtgatatggtatttgaggtcgatagctcctccaaaacgtgccttcttaaaataactgtcaggctttccctggtgaatagccgtagttgtaaattcccaatgttcacccaaccgatgtctgaaactgatagacaggtggcttttgatacttcggctgtatgcatacgttcctgcaaagaggctagtggctggctgttcccacttttcgaattcgaaaaatacccccaatgttgcaaacatgagacagttatcactatttaccagccgataacgcgactgtaatcccgtagaaaccttatatttcattcctctactttctgcccattgcgactcgacataaggataaacctcaaaaacatgatgcaacaaatagcggtattcggtgtgtacatatcctccacttacggttactttattgccataggtagaaaactcaagcttattaattaagttgattacttgaccgtgctttatcagcagattgagattggcagtatttttgaaggtgaacacattttccttttcggttttgaaatccagtacgggcaatatcgttccttgt

SEQ ID NO: 940 - DNA (genomic), 793 bp, PORYPHYROMONAS GINGIVALIS; double-stranded, circular
  misc_feature 1...793
  hypothetical: NO
  anti-sense: UNKNOWN
atattactatcgtcctcgcagagaaagattcttgttttttcttccatcttcttctcctctaaaaaatagttgtttttattattaatgggctactaaagggcttcccgtttctcggactggtgcgctgctcctttattcacctccaaatgtcccaattctattataaccgctctctataagaacgaatatttaggtttaattgttttgtacaaagagaaataagacaataatatcctaccctatcgatgagtctatctctttaaagaccagattcagaacattttctttcggatagacttcataaggtttttataacagactgcaaaataaatgttttcttgtcaataatcttcctcttggggcgcagatttacagctgctcactccgatcttaagtgcaacggtttgatagatttaggatgaaaagccttgtggggctctaaggttatcttatccgaaatgtatcttcggtttcggataagaggacgattatcaaaccaaaaaaccggaaaaagtcgaaccggatcttcgaaaaacacgcgcgtaaaaactttcgttttggcgcgtaaatttttcagttcccgaaccaaaacaaaaaaaattacgaaccacgtttttgggaaccataaacacgagaaaaaacggtcgcaaacggaatcaatgcttttctcgctaccgttcctctttccgttcggtaggttcctcttatctatatatggtgcgcattgcagggcttaagcatttctatcttatctttgtacgaatctctgaaaacaaagcgaagaaaaagctaa

SEQ ID NO: 941 - DNA (genomic), 754 bp, PORYPHYROMONAS GINGIVALIS; double-stranded, circular
  misc_feature 1...754
  hypothetical: NO
  anti-sense: UNKNOWN
ggcaaaaaattcaaaatcttcctgcccggcaggtaacgaccagccaagaccgatagcaaggctgcgcaatacatcccgcttctcccgggtcgatttcgttccgatggaagcacgaagggcaaagagtgctttcatcttggccactcgctcattgtgacggcccacgaatccctccaacggcctgtccgcatgcaagacgagcagggcttctatgatttcaaggaggcgattgtagtgcagccttatcctatgccgcatttcacggttattgatgatcagacgctcaccctccgtattgtctctcaggtcgaacagctgatcgaatgccttattcgcgttatccatcttatcgatccaagcagatacatttacggtttgtacgtcggaagcatgtttatcgcttcgcaatacctccaccagcttgtacatcagctcggttttgttccgatagctctttctattcaggttattatagggtttgagcagaataaacagacgtctcgctgcttcgcgatggtcttcttcgggtctgtgagtctctccctggatacagcctataaaattccgaaacgctttgctgcgaacagcatcgagagcggttattttctccgagtattcgcttgtcttgttcatggcaataccttttttgaaagtagccagcaccttgtccagctcatccaaagtaggaataatctcatttttactgagagtgcgagcatctttgacctcatcgatcataaaattcagaagctca

SEQ ID NO: 942 - DNA (genomic), 959 bp, PORYPHYROMONAS GINGIVALIS; double-stranded, circular
  misc_feature 1...959
  hypothetical: NO
  anti-sense: UNKNOWN
ccggtctggaagctcatctccatgccggacaattaacggctctgctcggtgtgaatggtgccggcaagagtacgctcatgcgtacgatggcaggattcatgaagcccttatcgggacaaatacatctactggggcggtcattggacagctataaagagatagaaatagccaaacgtataggcgtagtgctgaccgataattgccggattgccgggatgacggcaggcgaactcgtcgcattgggacgtagcccttataccggattctggggcagattgcagaaaggagacagaaagctcgtggcagaagccgtagaacgtgtgggaatcgctccgctgatcaatcgcgaactaactacgctcagcgatggagagagacaaaaagtagtcatcgcaaaagccctggcacagcagacaccgatcatcttcctcgacgaaccgacggctttcctcgattatcccagcaagatggaactgttgcacctcttgcacagcctggcccatgataccggcaggactatcttcctctccactcatgatctggatgccattttacccatggccgatcgcgtttggctgctggacaaggagcgttctttccgtgagggctcgccggcatctttggcctctgcgcttgaagattatttcggctatatccatccttctcccacattagagccggtgtagcatgctcgccggtgtataatccgatagctttgctcccccaatcaaagctatccggacagcccgatcgttccccttctctttcctctttcagttataatgagccgaagtatagctcctttcggtataggaatccatgccgtttgacctgccgtcatgtatgcaaggccgacttataccataagagctgtgtctgtaaaaacggaaaaggagtgtgccaaatgcagtgaaccctgaaagttcgatacaaaacattcagggttcacttcaaaaccg

SEQ ID NO: 943 - DNA (genomic), 3630 bp, PORYPHYROMONAS GINGIVALIS; double-stranded, circular
  misc_feature 1...3630
  hypothetical: NO
  anti-sense: UNKNOWN
agagatatttcggcagtacggaatcgcccggggagatacatattgctcgcttcgcactactgaagatcgtcaggcgaaagatcagctccagtaccttacggcggcgaattccccgataatcggctgactcccgaagttcttctgtctcggaagcaagacggtcaaaactgtaatacggtgtcttttcctccaccacccgtgtcagcaggtgaaacacataaggagagtgaacatggtgtcctccacgatgcagcagatagcgaacaaagcgcaatgcatgcaagtgcactctatcgctgacagataggaatgaagaggagagacaagacattgacaagatcggtcggataataacttactcctgctcttggggcaagatcagattgagtactacccctactatggcagccaaaccgataccggccatcgtaaatccaccgaacgaaacgactgctccgccgataccgagcgtaagagtgatggacactataataatattacgtgtccgactcatatccactttatgattgaccagattggcaatgccggccgaagctatcgtaccgaataggagcagcatgataccaccgagaacggcaggagggatggatttgagcaaggcactgaccttacctacagctgagaaaacaattcccgttacggctgctatacgaatcaccatcggatccgtcacacgagttagggccatggctccggttacttccgaataagtagtcacgggaggtcctcccagcagacctgctaccatacaggccaaaccatcgcccaagagggtacgatgcagccccggatcttttacaaaatcttttcctgtcaccgtatttaccacatagacgtcgccgatatgttctatcacgggagcaattgccacaggcaacataaagaggatgggaggaagagagaacttggggaaagaaaactgaggcaggctcaaccacgcagcctcacgaacaggattcagatcgacctcatagaaaacaacggctatcacatagcctaccactataccgcagaagatgggaatcagcttgaaaagccccttggccagcatagttactagcacggcggtagcaagcgatatagtagccagtatccagttggattgtgccatatccactccggctccggcaagcgaaagtccgatcaggataatgacagggccgatgactacaggcgggaacaaacgttggatcacacgtactccctgccacttgaccaaagcactcatcagataataaaccaatgccacaccgaccatacccgaaagagcaccgggcagcccatacatctccgtagccttgataataggagcgataaaggcaaaactactaccaagaaaaataggcacctttcctttcgtcaccaaatgaaaaatcaatgtaccgatgccggccgtaaacagggctgtcgaagggtctaaacccacaaggaggggcactaaaacagtagctccgaaagcaacaaagaggaactgtacgcctacgatgctttttcggagcggagagagttgggttgtttccatataaaaaaccgattataatttgctggattttaagccctgcaaatatatggcatttccctttatcccattgagttgcatgcttgttttgcaataattcgaacctatcgtttataagcagaacacgatgttccttgggattatacttaaaagtccacggactttatactataaaccctccatactttatacttaaaacccctatggctttatactataaagtctcctgcgtttatacttaaaacccttggggctttatagtataaagtctcaaggtaatcgaaaatagacccgacataagttttttcatacatttgtttcagtttttagccattatattatatggaaaggttagacaaactcgacaggcgaatcctgagcattatctccaataatgcccgtatgccgttcaaagatgttgcagaagaatgcggcgtatcgcgtgctgccgttcaccagcgcgtacaaagaatgatcgaaatgggagttattacaggttcgggctatcgtatcaacccgaagtctttgggtttcagaacatgtacttacgtaggcgttcgtctggagaaagcctcgatgtacaaggatgtactcccccatctgtacaacattcccgagatcgtggagtgtcactatacgacaggaccctactctttgctgatcaagctcttcgccatcgacaatgaccacctgatggacatcttgaattcgaccatccaagaaatccccggtatcgtctctacagaaacgctgatctctctggccgaaggattcaatcgtggcatcaagatacccgaaggagagcaataagcacatgcctatttatacatataccctcaccgatcggatacgctaaatgccgtcctatacgcttacccaattagcctctgctgtccggaattgtctcgaaagcggattccccggacgctattgggtcagtgcagagaccagtggtgtccgcgtaggcatatcgggacattgctacctggagttgctggacaaggatacatccggctctcaagtaacagcccgtatgaaagccatgatatgggcttcggactatgccacattatcaggacgctttcagagagaaacgggcgaaacattcgattccggtctccacgttctggtactggtaagtgtatcctaccatgagcaatatggactaagccttcgcattctggacatagacccctcctacacaatgggggctatggctcgcaaacgcaaagagatcatcgaagaactgcgccggcaaggtctatacgacctcaatcgcagcctgtccctaccccgccccacccaacgcattgccatagtctcatccggtgcagctgccggcttcgaagatttcatcgcacaccttagccattcggccgagcatttctgtttctatcccgtcctcttccaagccgtgatgcaaggagcacaaaccgaagcatcggtgttgggagctttggagcgcatcgcatatcaccgggattctttcgatgtagtggtcatcattcgcggaggaggagcagtgagcgaactggcagctttcgactcgcttgccatcggacaagcatgtgcacgcttccctctccctatccttaccggcatcggacacgacagggacgagacggtggtggatctggtagcttatcgttcgctcaagacacctacggctgtggccgattttcttgtaaactgccagcgcgaagagtggaaattgatcgacgaccttcgctcccgtgctgccgaaggacttcgaatgatgatgatgtactgccacgaacggctgattcagctatcgctccgcacaccggccatactgaaatcatctgttcgtgaagaacaccatcggataaagtccgtagaagatcgcatccgattagccgctaaacagcggatcgccttcggacttcagcaactccaaatagcaagccgcagcctgccggccttgatgaagagcgaactgaaacaaaatacgggtcaattggatcaggtagcagcccgactgcctttattggtgacagccaatctgaagaactacaatcgacgcctcgaaaccaacgaacaggccatccgcctgttgcaccccaatgctg

SEQ ID NO: 944 - DNA (genomic), 1145 bp, PORYPHYROMONAS GINGIVALIS; double-stranded, circular
  misc_feature 1...1145
  hypothetical: NO
  anti-sense: UNKNOWN
cgatatggataaactgcatgtggctcaaaggcgtggtgatgcgtgcgcacttcaacggcaagataccgagaaacccgttcgctcagttccatgtcagcccgaacacgaaggagcgtgcgttcctcacggaggacgagttgaagacactgatgtcgcatgagttcaaggacagccattccgccttcgtgcgtgatttgtttgtcttcgcctccttcaccgccctttccttcgtggacttgaaggaactcaccatcgacgagattgtggaggtgaacggtgagaagtggatacttgcgaaaaggcacaagacacaggtgccgtaccaagtgaaactgctcgatgtacccttgcaaatcatcgacagataccgaccgttccaaaaggacaactccatattcggggacatcaactactggacggtctgcaagaagctcaaaaaagtcatcagcgagtgcggaataacaaaagacatctccttccattgcgcaaggcacggctttgcgacattggcactcagtaagggcatgccgattgagagcgtgagccgtgtactcggacacacgaacatcgtaaccacgcaactctatgcgaagataaccaccgagaaactcgacaccgacctctccatgctcggcagcaagctcaacgcctcatttggctatatcaaaatggcatgacaatgaaagggaaaggcataaacagcaatgtccgtcagataatcacggtggacgaacatgggaacatcaccgtacccaatgaagaaatatggatgagcgagtatgagattgccgacctgctgggcgtattcggacataccatccgcacgcaggtcaagaagatatacagggatggactgctgcactcctgcacggcagagaggaacatcagggtggcggagggtcgctggcttgatgtgtacagccttgaaatggtcatagcccttgcgttccgcatcaggtcgcaaagggcaaaaaggcttcgaaagcatgtcatcgcaatgctgaccgaacgacacggaggctttatcatgttcctcccagcagaagcaggttgttcctgctaaaacagcctgacagggtttatagaggtttgtccccattgacacaaggggataaaccttttttcttttttggtggctgggagac

SEQ ID NO: 945 - DNA (genomic), 601 bp, PORYPHYROMONAS GINGIVALIS; double-stranded, circular
  misc_feature 1...601
  hypothetical: NO
  anti-sense: UNKNOWN
gttttatggattcaagctacatattgttatcaacgacaggggtgaaattatcaactatcaaatcacaccgggcaattgtgatgacagagaacctctgaaagacggaacattcaccaagaatctttttggcaaactcattgccgatagaggctacatttcccaaaacctttttgaccggctctttgtcgatgacatccacatgataaccaaaatcaaaaagaacatgaagaactccctgatgcatctatatgacaaagttttattgagaaagagagccttgatcgaaacggtcaatgatatactcaaaaatctctgccggatagagcacacgagacatcgcagtgncaacaattttgtcaccaacctgatctccggtatcatcgcttacaacatcctgcctaaaaagcctgaactcaatattgaaatcatcagaaaccctaactttcctatttccgcttagatcgaactgacgttatcttatatgaatgcaggtttcagcagaaagggaagataggaggctttagcctttgtacacggtaattgttgatttggaaaatttttctttcggagggttttgtccgaaacctcgtatatttgtcgg

SEQ ID NO: 946 - DNA (genomic), 1893 bp, PORYPHYROMONAS GINGIVALIS; double-stranded, circular
  misc_feature 1...1893
  hypothetical: NO
  anti-sense: UNKNOWN
ggccgaaaaaggctttttcgagagccgaaataaaagaggcacccgcctgattcgcctacaaatcaagcgggtgccttatgaaattttaggtggtgtcgaagtcttattccactctactcgtcatagcatagtaagcccctttgtccgaaatccttgtggcatatcggatcattatcaggcgtaaagcaggagagttggggcgttgggctttcttttaagtgtaaattaaaagcaaaagccgaagtctttaatcgtccaatcattatcagtacaatatatcttctatttacttgtgtccagcaagaagaaacgcttgctttggcctatgcatctctcggctctatggaagagatccttatcagaccttgcaaaggtagcaaaaatttttaggacaccttttttgttcaaattagttgttaatgtggactatttaaattgattgagctttcaaagcttagcttattttattgacgtatacaaatctctctatgtgtaattatacaaacgtaatcatacaaaaagtaacttgataagcataaggtttgtgctgtacaacaagtatattatcttttttcttagttgacggtcagttgccaaataagactacctttgtgctcggaaacggcggcaataaaacagatgccgacaaaatatcgatttcatgatggcggtcactatctatcatccggcagaattgcctcagcgacaggctgaaaaatccccaaataagactataatcaaatactacgatcgcgaaagcaaacaatggcgcaatatcagttggagcaaatttgctgccggcgtcatgaatgctgcgaaagctttagccgagatcggtctggaatcgggggaacgaatcggtatctattcccccaatatggtacactgtctgtataccgagttgggggccttcgccatgcggggtgtagtagtgcctttgtatgccacaagctcaccggaacagttacggttcatcgtggaggattcatccatggagacattgtttgtcggagagcagttccaatacaacaatgcttatcgggtacagaaagaatatggtacgctaaagcgcatagtcgtattcgatgagcgcgtggtgctcaatccggaggataagacttcgaaatacttttccgaatttgttcgtttgggtgattccatgccgaacgagacgaaggtcaaagtctcttctcgcgaagccattccttccgatccggcactgatcatctatacatcgggcacttccggtaggagcaagggcgtcctcctcctgcacagcaatctgatgtatcagatgaaagtccatagcgagcatatccccgtctatgggccgggcgagctgtcgatagctttcctgccgatgagtcatattttcgaaaaggcatggacactcttttgcctgacgacgggaacgaggattgccatcttgagagatccgaagaaagtattggaggcactacctcagatacgcccatcgctcatgtgcaacgtgccacgcttttgggagaaagtgtatcagggcgtgaatgagaagatggcctcctctccccgcatcctgaaaggtgtctacaggcgtgctatggccgtaggccaacgctatcgtctcgactattggaatgaggggaagcgtgcgccactgcttctgagtatgcaatatgccttttacaactgcactatttttaccctgctcaagcgcgtactgggactacagcgagggcgttatttccccacggncggagcaccgctatcggatgagatcaacatcttccttcagtccgtaaacattcccatcattgtcggatatggtctgtccgaaacgactgccacggtatctttctatccgcagcgaggattcaagatcggctncatgggcaaagtgatgccgggctggac

SEQ ID NO: 947 - DNA (genomic), 2520 bp, PORYPHYROMONAS GINGIVALIS; double-stranded, circular
  misc_feature 1...2520
  hypothetical: NO
  anti-sense: UNKNOWN
ggcaaggctcctttgatcggacggagcgatccatccaacgaaagctcgcccataatcatatagcgcggcagagagtctgctccgataatgccatctgcagccatgagtgcgatggcaaggggaaggtcgtaggcagtaccttcttttttgatgtctgccggactgagattgatcgtaatgctcttttggggaaaggtgatattcagacagtcgtatgtggagcgaatcctatccagactctcacggactgctgcatcggggagtcctaccatactgagatagcaacctcgggtgatattgacttcgacggtaacggtaagggcgtctatgctgtgcagagcagcggcaaaggtctttactaacataataaagaaacagggtgcgaaaggactatcggagactgtagcttgcacggcggctacggatatttccggctgtgtcgatgtggatagtatatggaaggctgtctatgccatatcgctcgagaagtgtcgatacctgtccgatactatccgatgccacacgtccgggcaaagccaacttcctgatgagtttacggagagatgagtccggtgcaaagagcgagagagtaagggtttccggctttgtctttccttctttatctctccatactttcaatgatgtagcggtagtggagtcaggcttgttcgtgaagagcaaaagcacatcttgtcccctataccaggaaagagtgaaagatcgctgatcaatatccttgacaaggaagtccggagccaaacggccgactgcgtacgacttattccggctaaggatggaatcaagagacgggggaagccggtgcatcgagataccggagcggcgaatgaggtctatgtcgaaaaggtcgtattcctccgctaatctgtttataccggtggcatcgggatgggaaagatagaagtcaagggctttgagccgcaagtctctgaaggcttttgctttggaggggaagtcggtggttcggagatgatcctgatagcgatggatctcttcttctgcagtttgcatgaactcgttcagtgtggcatgtgtacttcctccttttattttaggcaggaggggttggtcggcatcgagagtgattttaatatcttctcccttttcaggatagagccgaagcacgttattgccctcgttgaaatataatagaatgcgactaacatcgcctttgatttcgtgtcgaatctgtgccttgggcgaagtaacgtgtatctcttctgtgcgaaaggagccttccccttcaattcgcagagccagaaccgaatcgcctcggctgagattggagagattcagtttgaggtggcaaacatcagatgctctactgcatgaaagagaaaggagcaggacaaaacctgctactatataatatagtatgttggatggcttggacattgggacggagtgtttcatgattccgtaggaagtcggagcaggtattcctctacagtttccggatagtgtgcatattccaaagcgtggattctttgggccagcgtatccggagtatcttccggaaggaccggacagactgcttgacggaggattttgccgtggtcataatgtccatcgacaagatgaatggtgataccgctttctttttcccttgcagcaaggacggcttcgtgtacgtgatgtccgtacattccttttccgccgaacttgggcaataatgcaggatggatattgacgatcctgtcggggaaggattccaagtagggtgcggttatataacacatatagccggccagcacgatcaggtctatccctaattctttcaagagggcaatgggcttcgatccttcgagcatctcttgggtagtaaacgaataagccggtattttcagccgatgggcacgtgccataactcctgcatcggagtgattgctgaggatcacagccaagcttgccgaacctctttgggcaaagaaatgacacagattttctgcatttgagccattaccggaagctaaaaccgctacttttctcattttatttactatttttgctgcacacaaagagtgtgattgtgcagattttctggcgctgataatggactaacacggtattttctgtgctaaatccgctaaacagcgctaaatgaagcacaaatataagtaagaagattattagtaataaccattttaaagaacaagactatgtctgaagtagaaaaaaaagtgatcgacctcgtagttgacaaattgaatgtagaagcttctgaagtaacgcgtgaagccagtttctcaaatgaccctcggagccagactctcttgatacagttgagttgatgatgaatttcgaaaaggaattcaacatgtctatccctgacgaccaagcacaggagatcaagactgtcggcgacgctatcgactatatcgaaaaaaacctgaagtaaaatactccgatggaactgaaaagagtagtagtaacagggttaggagccattactccgcttggcaactctgctcccgaaacgtgggaaagcttagtggcaggcaa

SEQ ID NO: 948 - DNA (genomic), 1592 bp, PORYPHYROMONAS GINGIVALIS; double-stranded, circular
  misc_feature 1...1592
  hypothetical: NO
  anti-sense: UNKNOWN
gccttgactgccggcaaaatcctgattcgaagcgatctaaggaaaagaaagaaccctcccatcatggcaaaaagcatccaggcataggtgcctaatagatagaaaggcttgcgcagggtcagaacatcctgtatggtttggagcgtatgggtagagggatagcttggcgaaatctggtacataggcatccccccgaagagactgttggtccaataggagtgttctcctgtctgtgcctcccaatcgcgtacgtcctgcgccgtaccgctggctcccgctacgtcgccctggaacagtacacgcccgtcgaatgaggcgggatagaaataggccaaagcgagggctatgaaaaggagtacgaccgcagcataaggtaggattttgcgccaatcaggctttgtcttatcggtggtggttacggttccggcagcagctgtcggcttttcgttttctttcatgatgtcgtttgtttttcggttacaaagttaaaaaaccatgtgattggctcggcctacgaccaactgcttctctgaacgttgagcagagaagtatcctccgcacattgttattgtatgcaagaggtcagaaaatgagcagttcaaaccttgggacaagctctctccctattctatatacatatctgaggacaaagcgaaaccattgaggaaagaggcggcatccatttgtttcttgccgggcatttggagcgagagtatacgtatgacccctttgcgtgtcatcacgtcgaggtttttcttgtcccatatgatggagccgaatcggcctctgtgtcgcggttctcgttctatcacttgggtacggtatattttcagcacgatggactccatccttggacgatgaagcttggtccaagctgtaggagcaggcgatatgctgcggatgaaattgtgtacctcttcagccggtttgtcccaatcgatacggcagtcgtctttgaaaatcttcggagccggtcgagcatcaacatagcccggaagttgctcctgaggtatggagacgggttctccttcgagaaacaagtccactgtgtgcaccaatacggatgcaccgagagtagccatacgttcgtacaattcgccgaaagtctcttcatgtcctataggcaacttctcttgcagcagtacttcacccgtatctatctcatgccggaggcggaaggtggtaactcccgtttcccgtatcgccatggcgtatcgcgtggttggataggggctgctcctcgatacatgggcagcagagagccatgcagattgattgttcccatggggggcatttgccatacggagcgaggaagcatacggaaagccactacgatttgcaagtgcggctgataagtccgtagttcatcgagaaaagattcctcgttcagattgtccggctggagaataggcagacccaattcctgtgcgtatagtttgaccatactgggacttaccttatgtcctcgacccataggcttgtccggcatagtgaccacagcttttacttggtatccgttttcgaccaaaagctcggagtgccggaacagcaaaaatcggccgttcccataaaaatcaatcgtagttcttctt

SEQ ID NO: 949 - DNA (genomic), 1849 bp, PORYPHYROMONAS GINGIVALIS; double-stranded, circular
  misc_feature 1...1849
  hypothetical: NO
  anti-sense: UNKNOWN
tggtctctccgatttcgaaactttccaaaccgatgatagcgcatatatctcctgcatccacatggtcggctttggctcgtcccaagccttcgaaggtattcagctccttgattcgctgcttctgcatcgtaccatcacgcttgcagagcataatatcctgcccttcgcggagtgtgccgcgatgtactcgcccgacggcaatacgccccacataggaagtatagtcaagcgatgtaatgagcatctgcgtggcaccctccggctgttcgggagcggggatgtgtcggatgatggcatcgagtagcggagcaatgtcctgtgtgggatgtttgtagtcggtactcatccaaccctgcttggccgagccgtatatggtggggaaatcgagctgatcctccgaagcatcgaggctgtacatgaggtcgaacaccatatcctgcacttcgctcggacggcagttgagtttgtctactttgttgatgacgacgatgggtttgagtcccatctcgatggctttttgcagcacaaaccgagtctgcggcatcggcccctcgaaggcatccaccagcaggaggcatccatcggccatattgagcacgcgctccacttcaccgccgaagtcggcgtgtcccggggtatcgatgatattgattttacaacccttatagcgaatactgacgtttttggaaagaatggtgataccgcgttcgcgttccaagtcgttgctatcgaggaaagtatccacttcggcagccttgtcatccctgaaaagcttgccggctaagagcatcttgtccacgagcgtggttttaccgtggtctacgtgggcaatgatggcaatgttcctgatgtcctgcattttcttcttctgagtaattggggacaaaggtagtaaaacgggctgtttttcggaatggatatccaagtgttcggattctgcacattccatctgcaagagcgttgcatttgcaggcaaaaaaagacgccgacgaaagtgctctcatcggcgtcaataggattccaagatatctcttgatagagtttttcagctgacgatatccgtcttacaggatgatgttcttagatgtctgtgtattatcagcaaacaaaacagtgacgagaatatggcctttcgtctttaagtcgatacaaaattctctgccctgtgtctgactcgtggcaaaaagcatccgtcctgccatatcataaatatagaccgatttgatcagtttttctgccttgatgccgatggtcgttccttggatgtagacgtttatatcgttcgacgaaggtacaactgtttggctatctgtcgtatggcatgatttggcaaccgtgctatagaagataatgggatacttcagctgataatcctgcacaatgtctccctctaccctgacgcgcgtttggaggggataggagtttccggctatcattacttctccgttttcactactgataaagttgccttcgtcatctttgattgcgatctcgaagccgctgtcgtcttttacgcaaacaatagtcgctgtcacttccggatacgtaaattgcggcatagggatctcggtaaccactccctcgaaagttcgattggggagagtgatgcgtgtgcacatcagttcatagtaggcatcgaattcatggaaacgaccttctgtaattagcatatcgcccaacttggcgtatggacagaactcccttaaccccccataataagctgtaggataataataaccttttccctgataactgaatggtgctctaaaggctatcggttgtcaaaggcattcagttgtgcatcacagaccatccccagccgagtgataatcgaccgggactgtgtcgg

SEQ ID NO: 950 - DNA (genomic), 1841 bp, PORYPHYROMONAS GINGIVALIS; double-stranded, circular
  misc_feature 1...1841
  hypothetical: NO
  anti-sense: UNKNOWN
gagtgtgcctccatcggcatctctttcatttggtcgatgattgccttagcctcagtagctcgagccgatctcttcatatttagattacgcttgaccagagcttggttgacggcgagtaccgctgcatctcgccgtgcttgccaatccttgggcaaggcgaaggaggcttgagctccaaacgtagcagagcggaaagcctcgtacatctgtggggcagagagcatagagcacttatcctctagggcatcatagcgaacgaacatcgcagggcacttggggctgcggacgacgaagagagcttgcccctctgtctcagatacagccaactctagcccttcgctctgccgagcgatatagtcgtatcgttctggatgctgcgccttgtaggttttgagctcgtagaggtattgctctagggcagactccgcgccctcgatctgggttttcagctcgtggtgtacaacctcttcttcttcactgaagatttgactatcctcaccgaaaagtgtgtggaaagactgtagcttggtatatgctttcttgacgagattgatctcggcatctccctctgcactcggcatgaagttatagacatagacgcagggagcttgggagccgatgcggttgactcgcccgatgcgttgcatcaggcgcgtagcattccatggagtatcgtagttgagtatgctgttggcacggtgtaggttgataccctccgcaagcacttctgtcgtgatgatgatctggtagtcatctcgctgctcccctttgtagttggcatcgaaatttgctcggatatcttcctcgcgctctcggcggttcttcgctgtgatcgagagcaccgagaggcggtcatcgacactctcgatggcccgctcaatggctcgcacagtgtctatcgcctcggtgaagataacgagtttctgctctggattacgctccagactgagcagactaggtagcagctgtcgcttaaaatcgtctagtttgggatcgtcggagtagatgctccactgctcatctagctggtcgatgagggctagatcctgacggagtagatcaatgtattctggagcaaagtcctcacgtcgatactctctatttcgccctttctcattcgatccagaggagttgagcttgttgatctttttgcgtagatcctcggcacactcttcgaaggagaacaatttcctcgtactatcccaatgcttacggggattgagctctgcattcacatctatctgtgggcagatgaatatggtatcgtgctcccacatatccaccatattttgggtgtaacgcttgagatttttgagcgagaccttgaaggcggagaagctactctcgatgcgttttaccaggccaatctgcataatgcgtgctagctgatgggagaatcgctcggcatccatgttgcgccccgagtagagcttacgcgtgctctcgtctctcaggtactcaatagctcgatatcggtagtagcatagagaggtagagctgtcgaactgaaaattctctttcggcgcaatgcagtccatcgtacgagcgaagagtttggcaaggctcttgctcatacgatactcaaagctatgagggccactaatctcgggaaaggtaagtttggtctcagggtagtacttacggatgtcggttcgggtgcgtctgacgagtatatcctgtaggacgcagtctcttacgcgactagacaagtcattgagtagtttcctactctgctgtatttgctctgccgttgggccttcgtcgtagcgagagtatatgacagattgatattcacgagctatatcggcaaaaaaactctccagattgccaccattggcctt

SEQ ID NO: 951 - DNA (genomic), 1460 bp, PORYPHYROMONAS GINGIVALIS; double-stranded, circular
  misc_feature 1...1460
  hypothetical: NO
  anti-sense: UNKNOWN
atttgagtattaaaaacagcataatattcctcccatggcataccaatccaagaataccgatgagcatgtaacatttgcagacgcactcctttcaaagcgttatcgcaaagcacaaaacgacttcctcaatcaggttgagaggcttatcgattggcgtccgatcaggacgctgatcaacaagaaatacacgaagcgacaaaatgccatcggcgccccggcttatgacgtgattctcttattcaagatgttgcttttggagacatggtacaacctcagtgattgtgctttggaggagcgcatcaatgattcaatcaccttttcccgattcttgggactgaagatggaagaggtatctcccgaccacagcaccatcagtcgatttcgttcggcactgacagagttgggctcatggacaaactattggcgcagtttaacaaacaactttcccgccatcacatttcggtcagggaaggggtgcttgtcgatgcaagccttgtggagacgccacataaaacccaacggaaccattacgattgaagtcgcagacgacagagaagacaatcggagcgaggcggaaaaagaggcagaggaggattaatcaaaaacaggttgtccgccggcgtaaagggacggatgaagaagccgttgggtgtacaaacaaaagcgttatcactacggatacaaaaagcattgtcctgaccaatgttcaaggcattgttcaaaaggtgataacgactgcagcgaaccgcagtgacacgaaggagtttattccgctattgcagggtgcaaacatacctcaaggcacagccgtcttggcggacaaaggatatgcttgcggggaaaatcgttcctacctgcaaacccatcaccttcaagacggcatcatgcacaaggcacaacgcaacagggcattgaccgaggaagagaagcaaggaaacaaagcaatcagtccgatacggagcaccatcgaacgcacctttggcagtattcgccggtggtttcatggcggacgatgtcgataccggggacttgccaagacccatactcaaaacattcttgaaagcatcgcctttaatttatacagaaccccggggataattatgtcctcatctctaggataaggcataaccccccttgaggagctcgtgcaagtagctccgcaaggggggatttacaactactttcactccttactgccacccttttcactcgctccttttttgccaagaactcctcttccctccatctccttattttgcaaaggtctcttctatataaatcgaaagccgaaaaggccacttcgagaggctataaaacagaggcacccacatgattcggctcgaatcatgtgggtgccttattcttttgaagggactgtaagagaccttattgctgcttatggatcatggggattatactattcgtccgtatgccacatggcatacatataatatcggccg

SEQ ID NO: 952 - DNA (genomic), 822 bp, PORYPHYROMONAS GINGIVALIS; double-stranded, circular
  misc_feature 1...822
  hypothetical: NO
  anti-sense: UNKNOWN
ggatccttagtcctggagcggattagccccctgactatcaatttttcgaaatgtggtcatccccctatgtgctaaaagagctgattttcgggctctggcggaggcgtaaacggctcattaagccattgcatcagatccatcttggtaaatgtgttgattcttagcgaagagacaagattagacaagcaccaccgatatttggcgatactcttgagatagaccatcaaaagcattgtaataagagcggtccatatttgcacctctacggcattgcgcgttgttccaagaaaggccttcatgctgaggcgttgcttcaaattccgaaagaaaatctcgataagccatcttgaacgatacagcaaggctatactacttgctgcaagggtgtctatgttggtcaataactcaacgacatcgccatgtttctcgttgtagagggcaatatgcctcaatggcttagtgtacttgccttgcgtctgaacgcctgtgagccgtactctctgatctactagtatttgctgatgcccatgttctgggagttccaactcttgaataacctcatattttaaggaccttgggtggcgtactacaaaactcacttgggtgctgtcccaactattgagcaaggcggtatcagcatagccacggtcagccacgacgatacttcctgctgggataggaatagaattggccatcttgccatcatgtcctttaccatcactaatatgcacatattcaggcaacagagtcttgaagtctaagagtgtatgaagcttaacagctcccttcgtatgtgtgtatttagcccaatcgtatagggca

SEQ ID NO: 953 - DNA (genomic), 1045 bp, PORYPHYROMONAS GINGIVALIS; double-stranded, circular
  misc_feature 1...1045
  hypothetical: NO
  anti-sense: UNKNOWN
atgagcatgattttcaaaaatgacaatcatcaggagtcgtttgtctttggcttgtccactacttcgaaattgttatcgggtgaaggcaaatggcgactcgaactgcccttgcaggctattgccacgcatcgcggcggggaatacaactgggcgcagcaggataccgtgcatacatgggtcaatggagctgtcggacttaagctttcgtatcgccctcgtaccgacaaacccatgcagatttggggatctgcttatggtgtggcagccttgtcaagcggaggatacttcccttacgaaagagggtggggcggttatctttctctcggaatggacttggagcacttcgcttttcgtaccgactattggtacggcaggcattacgtttctccctttgctgcacctttcgccaattccctgacgtatgacaaacagcctcttacgaacggttggggcgattatattcgtctctatgccgactattcgtggcggatggcacgaagtgtttcgttggcggctgttgctcgggtatggttccagccttcggatcgttttgcgatgagccacgccttggaactgacgatgcgtatcgatcccaaattcccaatagcttttctgaaaggcaatcattgatcttttcgatatttgcgagtggattcctcagtgatcatttagtccggtaaggttgggtgaatgccaaaagaaagaggactgccaaagagctccaagctcctttgacagtccttttcgtttatattggaatggatgtcgcttacagctatgcgatgtccatttccttcatgatctctgccagtgattccttggcatctccgagtttgaggaatacacccgttgctcgtgtgtagagcggattgtccacacctgcataaccgggtttcaggtcgaagttgcaaatgattacttcggagcatcgtccacgttcagcacgggcataccgtatataggcgtaccctcagcattgcgagcagcagggttcattacgtcgttggcaccgattactaccacggcatccgtctgagcgaaatct

SEQ ID NO: 954 - DNA (genomic), 600 bp, PORYPHYROMONAS GINGIVALIS; double-stranded, circular
  misc_feature 1...600
  hypothetical: NO
  anti-sense: UNKNOWN
caaatatagttgatgttttttgcatcatagatgatttctccaagctttttgatgaagcaatcaagaaaaagaccctcgaagaggcagacaaaaaacgcaggaatagaaagtttaagatgtcggacagtgaggtcatgaccatcctgatcctgtttcatctgtcaagataccgagatttgaaagctttttatcttcaatacatcacctattcttgtcgatccgagttcccacatcttgtctcttataatcgctttgtggagctgcaaagcagggtaggtttcaagctgatagcatttctcaatatgtgttgtttgggtcaatgtactggcatctctttcatcgattccaccccattgaaggcttgtcatatcaaacgagctcatgggcataggacgatgaggggatgggctcaaaaaggcaaaagcaccatgggttggttttatggattcaaactacatatgagacctttgcaaaataaggaggtggagggaagaggagttcttggcataaaaggagcgagtgaaaggggtggcagtaaggagtgaaagtagttgtaaatccccccttgaggagctgcttgcacgagctcctcaagggggg

SEQ ID NO: 955 - DNA (genomic), 1996 bp, PORYPHYROMONAS GINGIVALIS; double-stranded, circular
  misc_feature 1...1996
  hypothetical: NO
  anti-sense: UNKNOWN
tcaccggaagtggagagagctatgcagtgcgcgatccttggggcatccgacctgcattctattatatagacgatgagatcgtggtcacggcctcggagcgtcccgttatccaaactgtgatgaatctgtcggcagaggccgttcgggagttgatgcccggagaagctatctttgtcaatagcaagggagaacctcgtatcgagcgtatcttggagactaagaattatcaggcctgttcgttcgagcgtatctatttctctcgtggcagtgatcaggatatatatcgtgagagaaaggctctggggtatctgctttcggaacgcatcctccgagcgatcgattacgacatctcccatactgncttttcattcatcccgaatacagccgaagtggcatattatggtatgttggagggcatagatcattatttggatgaatgcaagattcgagagattcgcgagaacccgaatatgagtgaagccaagttgcgtgagattctaggacgaaaggttcggtcggagaaggtggcgatcaaagacatcaagctcagaacttttattacggaaggcaatagccgcaacgatttggcggctcatgtctatgatattacctatggcacggtacaagccggcgtagacaatttggtcgtgatcgatgacagtatcgtccgtgggactactctgcggcagagcatcatcggtatcatggataggttgcaacctaagaagatcgtcattgtttccagctctccgcagattcgttatccggactactatggtatcgatatgcgtaagatgcgcgaatttgtcgctttccgctccgctgtggcacttcttcaggagcgcggtatggagcaagtgttgcacgatgcctatgcaaaagctttagagcttcggaagttgagttccggacaggaggtcgaaaatgtcgttaagactatctataagcctttcacggccgaggagatttcagccaagatggtagagctattgaagccggaaggcgtgcgtgccaaggtggagatcgtatatcaaagtttggaaggcttgcatcaggcgataccgaatcatccgggagactggtatttctccggcgattatccgacacccggaggcgctcatttggtaaatgaagcttttatcagctacatggaagaggactatggcaaataattatttccagaatcgaaagagtattaagaacgtatgagagagcaaagaaaagcgacattgatattggacgatggtagccgtttcgaaggctattctttcggttgcgaacgtgctgtggccggagaggtcgttttcaatacggctatgaccggctatgtggagagtctgacggatccgagttatcgcggacaaatcatggttatgacctatcctttggtgggtaattatggcgttccgatgaaagcagctgagccaaacggcgtatcttgctttatggaaagcgacagaatacacatggaaggaatcgttgtgtccgactattcccattcttatagtcattggaatgctgtcgaaagccttggcgattggctcaaacgtgagcaggtattcggtctgacggggatcgacacgagggcattggccaagcacctccgcgaacacggttcgatgaaaggaaagataattctcgaaggaggcgaagacattggcttcgccgatccttacacagtcaatcaggtagcggaggcttcttgtcgtgaagtaatcgtctacggcactggaagcaaaaaggtggtactcgtcgattgtggagtgaaggacaacattattcgctcgcttctccgtgaagatataacgctctaccgtgtaccatgggattacgactttcatcgaatagcatacgacggtctcttcatcagcaacggcccgggcgaccccaatatgtgcagcgtcacagtggaacatattcgtcgggctgtggccggcgacaaacctatctgcggtatttgcatgggcaatcagcttttggcgaaagctgccgggga

SEQ ID NO: 956 - DNA (genomic), 2129 bp, PORYPHYROMONAS GINGIVALIS; double-stranded, circular
  misc_feature 1...2129
  hypothetical: NO
  anti-sense: UNKNOWN
tgccgtagatttccggttctcgcttgcccagagacgccagattggggccattgataatgtgtataagcttcataacgattgtttatctttgggaggcagagccataaaaaaacggcttacggcgcagactctcgttccggtgtgtgcataggttggcacacaacctctacaaaggtatagatatttgacaatgatagaagatagcctttccaagcgttacaagtcctacctcagtttggagcttcacctgacgcccaacagtgtggatgcttacttaaaggatttgagcaagttagactcttatctcacggctgaaaacatctcttttcgagaggtttcgtatgaaaatcttcaacatttcgtagccgaattgtatgacctcggcatcagtgcgcgctcgatagcgcgtatcatcagcggtgtcaagagtttcttccgcttcctcgttttggaagagtatatcgaagcggatcctaccgagttgctcgaaggccctcgcatcggtgtccatctgcctacggtattgaccatcgaagaagttgatcgactgatcggatcgatcgatccggcagctcagggagcccaacgcaatcgcgccattctggaaatactctatagctgtggtctgcgtgtcagcgaactgacttctttgaaattcagcaatctcttcctcaacgaatcatttttgcgtatcgatggcaaagggcgcaaacagcgtcttgtacccatgagcgagactgctatcaccgagctgaagcggtatctgtccgatcccgaacgcccgacccctgttcttggacaagaggagtatgtgtttctgagcaatcgcggcaaagccatctcccgcatcatggttttcgtcatgatcaagaagctggcagaagaagccggtataacgaagagtatcagcccccatacattccgtcacagctttgccacccatctgctcgagggaggagctaatctgcaggccattcagctcatgcttggccatgagaacattgccacgacggagatctatacccatatcgacagagaaacactccggcatgaaatcgagacctaccatccgcgcaatcaatcctatcgtcgatccggttccgaagctgaccaataaaaaatagctcccctcgccacagagagatggcataatggctatatcgaattttcgtctttcatggagagcatatcgaggtactcttcccagtcggtatcgacttcgcattctatctccagcggtaatgtttcgtaaggggccaacacctcattgagccgttcgccgaatactcgttcagtacgggcataatagacccaatactttgttccgcctccggtatagttgcctgtcatgatggccaacttgtccttttccatagccttacggatgagcagctcgatctcttcgatccgtttgcctgccgattctgtaggcagaccttgttcgtcggcttcgtagggccagcgtatttcgattcggattttcagcttgccactcagtcggaattcgtcaagctccaagcgtccattgacgaatactatgttgcccttctcatcctcactgatggaagtaaaccatcggtctgttagtttcattgtctgtcggttttattctttcgtttatcgtatagccagatttggatggaattgagcgaattttgccataccacatagcttgcaggtgcgatagaagctatcggattcaaataggtaagcgacatccaaatggcaagcgacgtgtttttctgtcccaaagcctgaccggccgtaatgctctctttcaaatatcgtttgcttagccacntgcccaacccgaattgcaaggcaacaagctaagcagaccacccaacgccaacagcagctccaaacggatgctgtcggagccttgtgccatcacatagcctgtcgttttggccatgatgatagccagcgaggtaacccatagccaaaaagccatttggggaatgcgcagaagccgggcatgtgtccgagggctcgtgaaacgaatgatccaagcagccaatagaggaaccaccaccagaggcaagacaccccaaagaatatggatgacggaagaccaaaacggcatatcggcatgtgccgtactcagcgaagaaaacagcaaaggcccg

SEQ ID NO: 957 - DNA (genomic), 2234 bp, PORYPHYROMONAS GINGIVALIS; double-stranded, circular
  misc_feature 1...2234
  hypothetical: NO
  anti-sense: UNKNOWN
gtcaacttttttcagtacacgtcaaaaaccgaaaagtttacgcgccacgtttttcggtactgcgaatgatcttttttttcgcgcgtaaatgccaaagactgtcggcttcgaggtacagatcgaattcggatcgctctttcggagctgacagtctttcttctccgagaagaaaaaaggaacctgtgggagtcgctcaccatgggttttcttgctatttttgttcgtattcggattccatcctaagaggacgaccaacctatgattgcactcttaataatcgtatacatgctgatgacggctgccgtcagtgctgtcattatcagcgagaatcgcaatccactgaaggctacttcgtggattctggtcgtctcttttgtacccgtcttggggcttattgtctatatctttttcggacaggatcagcgcagacggcgtattgtcagccgccgtatatacaagcgcatcatgctgaagcctcactatctgtccatccccgaagcacagttggaagccatgaacaatatccagctgaatcccatcatgaagctgatcaacaacaactcggacagccccgtcatgctcagctcgccgccggatatattcacggcagggaaggatatgttcgactgcttctttcgcgacatagaggctgcccgccaccatgtgcatattcagttctacgtcatagaggatgaccatctgggcagtcgcctgtccgatctgcttatacgcaaggtgcaagagggcgtgaaggtgagggtcatattcgatcatgtgggttcgtgggctacgggccgtggctactggaaacgactgcgccgagccggagtggaagcctatccttttatgccggtcttcttccccatactgtccagccgcgtaaactaccgcaatcaccggaaggtagccgttatagatggtaaaataggctatttgggcggtatgaatgtggccgatcgctattactcgggcaacaggctcggtctgtggcgcgatactcacttccgtatgatgggcaatgtggtggccggtttgcagagcagtttcctgctggactggtatgtcgtatcgcgacgagtcatcaatctctccggctactatcccgatctgccgatacccgtatccgacgagggtgtgaagatacagctcgtacgctccggccccgtggggcaatggcgtaccatcgagcaggccaccatctactgtatcgagcgtgcctgcgaacatgtctatatcgagactccttacttccttccgaccgaaggactgaataatgctctcatcacggcagctttggccggcatcgatgtacacctgctggtgcccaaacgaagcgatgcccgtctgccacaagtggcggccttctcctatgtggaggatctcttgcaggccggtgtacatgtacacctctataccaacggctttctccattccaagctgataatggtggatagtcaggtggcttcgatcggctctacgaatatggacttccgcagcttggaaaataacttcgaattcaatggtatcatctatgacgagcctactgtccaccgattggaagccatcttcttcgaggacttgttgcagagcgaaccgctcgatctcaaacgctggcgaaagagaagccggataaaaaaattcagcgaatcctttgttcgccttttctctcctctgctctaaccgatatgctttccgactacaagtatgatccatcgtccactattcattatcccatcctgtatccctcatgacaatacacgacaatactcttttctccgccgatgagcggagtcgcttcctctcctcatacgcgagtttgattcgtacactagctcccgatcggcagctcgtgaagaaagtacgcagtctgctgagccgttttacggagttgggatgtttcgatcgcgacaaaaacggtatgcacggacttttgcgcaacatggaagtggcacgcatagcctcctgtgagatcgggctggggatagaggccatcggagcactcctcttctatcgtccggcgatgaaggggctgacgagaccggaggagatagccgagctcatgggcgaagatgtggctcgcctgatcgacctcctgctgaaaacatcggagatctacatgcgcaatacggctatcaatacggccaacttcgagcacttcctcctctccatcgccgaagatattcgcgtggtgctgctcatcatcgctgaccgttcctatctgctgcgccaggccg

SEQ ID NO: 958 - DNA (genomic), 966 bp, PORYPHYROMONAS GINGIVALIS; double-stranded, circular
  misc_feature 1...966
  hypothetical: NO
  anti-sense: UNKNOWN
gctgagaaattggaggctttcggccgtctgttggatgttctggataccttgcgagagcagtgtccatgggatcggaaacagacgaacgaaagcctccgaacaaatacaatagaagaggtctatgagctgagcgaagctctcttgggcgagtgtccggacgacattcgcaaggagcttggcgatgtcctgctgcacgtagctttctatgccaagataggagaggaaaaaggccagttcgatattgcttcggtctgtcatgctctctgcgacaagctgatctatcggcatccgcatatctatggcaatgtacaggtggagaatgctgccgaagtggtacgcaactgggagcaactcaaactccgcgaaaaggatgggaacaagtccgtcctctccggcgtgccgaagtctctccctgctttggtgaagagctatcggatgcaggagaaagccgcaggcgtaggtttcgactgggagcaacgggagcaggtatggccgaaagttgaagaagagctgaacgaagtccgaggggctattgtcagtgaagatcccgatgccatggaagcagagttcggcgacttgctcttcgccgtggtgaatgccgctcgtctctacggtatcaatccggataatgctctcgaacgtaccaatagaaaattcgacagccgtttctcctatgtggagcagcgtgccaaacagcagggcaaagctctcagagatatgaccctctcggagatggatgcgctgtggaatgaggcaaaacagaaaggactctgacctcgttccaagcggaaaaagctatctttgtaagcacgatttagcattattactataatgaacgaagacattaaaaagaatacctcggcatcggaatattcggccagcaatatccaagtattggaaggtctggaagctgtccgcaagcgaccggccatgtatataggtgacatcagcgaaaagggattgcac

SEQ ID NO: 959 - DNA (genomic), 2677 bp, PORYPHYROMONAS GINGIVALIS; double-stranded, circular
  misc_feature 1...2677
  hypothetical: NO
  anti-sense: UNKNOWN
cggcaggattggtcgatttcttgcgtcgagccaaactcagccataccactgcggctatcgtagctacggctgcagcagtgcttgtccctatccagatggccggccagaactgggatgatcatgatcgctcgggacgctatgtgggacgcgatttcggtgtcaattacttggagagctgcgaccccaatgccgttattttcacctatggcgataacgataccttccccctctggtatgctcaggaggtagaaggcgttcgtaccgatgtccgtgtgagcaatctcagttacttgggagcagactggtatgtgcgccagatgaagcagcaagcctatcagtccgatccgctaccattgaagaatatgaatgaagccttcatcagccggaatgcctttgttcgtgtcgatcccaattactctgccagagatccggagctgaacctccattcactcccgggtagcggactcacggccgatggcaagcccatcatgatgctgtccgaagccatgaaaatagccgctcgtccggttccttatggcaatggtgtgatgccgtctgagaacctgtatctgcccgtagattcgcaagcattggggcaggcgtttggcgattcggctaaggtgcatgtccgtcaaaccatcgatctgtctttggccggtaagggcgtcctctcattggccgacctgaagcgttctcgatctgatagccaataacgaatggaagcgtcctatctattgggctattacgtctccgagcaattctttctccaacctgccggactacttgcgtcagaccggtatggccaatcagtttgtgccttttaaggcgcgccgcgtaggcgataacatcgatgtggaaaagacctataccaatgtgatgaccaagttccgcttcggaggggccaacaatcccaaggtgtacttcgatgcagatattcgcaattccaccaatacctatcgcgtagctgtgttttctccgttggcaaaggctctgctcgaaagaggcgataccgttcgtgcccgtaaggtgctcaccaaatgcctccaagagatcagtcctgaagccgtgccctatgattatcgctcgctggtattggcacaaaccctgtacgatgcagatatggtggccgacgcagaccggatagtcaaggccgtggcaggctcttcgatgcgtacgcttaactggttcttccgcctgtcggaatccaaattcatgcaaatgctttccgaaggagagatcgacagggagatgaatacggttgctacggctcttcggctgagtactgcttataatagcaaagtgttggatgaatatctgcccgtgttccagaactattataagatgctctacactgatgagcagggtaatagcaaaccgcaataaatgcagctcagactcgtagaacgacttatctgccgtgtgcccatgtggtaccgggctttgttccccggtgccacgtggcgcattcctgccaaagaaggaaaaagcatctatctgactttcgatgacggtcccataccggagataacaccctgggtattggatacgctcgatgaactcggggtgaaggccacgttcttctgtgtggcggataatgtgcgtcgctatcccgatctttttgccgagatacagcgtcgtggtcatcaggtcggcaatcacactttccaccatctgcaagggctgaaagtccgtacacgtacctatctgaaagatgtggaagaggctgaccgacttatcaattctcgcttctttcgaccgccgcatggccatcttcgcttcatgcagaccctcctgcttagcaatcactacgacattattatgtgggatgtgatcacgcgcgattataatgctcgcctttcacccgataccgtctttggttcggtggttcgctatgcgcgcaacggctccattattaccttccacgactccctcaaagcggctcccaatatgcagcaggccatgcctcgcgctgtgcgctggctattggatgaaggctataccttcaaatgtctgggcgacccggccgactaagccgtttacctgttttttctgtccgatgattgtccttacggaagacggatctcccactatcctttcgcctcattacggcgaatactaccactccatacacggtgcgtgtcgtgagagcgaacatgtattcgttcatacgggactgttgcaccgtttggaatctttcgatccttccggtactttgtatctctttgaagtcggattcggaacggctctcaatgcgctactgactctccgcgaacaacgatgtcggggtctctccatccattactctgccattgagaaatttcctctcgaaagggatgtatatgagcatcttcgcttttctgtgggaatggctgatgaagacaaactcctgcaaagtctccaccatgcaccgtggggaatggattgtgaaatatgtcccggcttcacgttgcacaagatagcatccgatctgaccgattttacattccgcaagcctatcgatctcatctatttcgatgctttctctcccgaagctcagccggagttgtggagtgaagagatcttcatccgaatggtggccgcatgtcgatccggagccgtattggccacctactgcgccaaaggcgagatccgccgtcggctcacacgtgccggattccatatggaacgccggggatcc

SEQ ID NO: 960 - DNA (genomic), 3250 bp, PORYPHYROMONAS GINGIVALIS; double-stranded, circular
  misc_feature 1...3250
  hypothetical: NO
  anti-sense: UNKNOWN
cgtaacgatcacggaagtaatggccgaagaagaagtgccgattctcatcgtattgtcctgccgataattcgaatggggtagtctgcgcaccgcctttggtattgactctcttggtctctgcctcctgctgactgaccaccatgtccacgtcaaatttgccgaactgcatcttcgtgtgtattccgaataagctcgctccgcctcgaatcagagtgttgcgcgtattcatggatacattgccggcttcgatcagtttgattatatcatcttcctctccttcgaaagccaacttcagcttctttgcatcgaaatcgaacgtactctctgtattatagttcatcccgaaattgagcttcgtacccactgatgcctgcacgttggtttggatcttttcgctgaagtcgaaataggaatgcttacgtgcattttcgggcagagaggggttatttgttgcattgctcttagcccccatggccacctcagccgatccttgagtacggagtttgaccccaccgggaccgaagagcttctcggccggaccgagatcgaaagacatttccaaaggattgaaccgcttcttaccctcctgctgagcttcaagtcgttctttttccatgaagtaacggcggatggaatcacgctgcatatagcgtaggtattcttcgggtgtgaagggtataggactgcccagaggtttatccccaagcttggtcacaagcagataagtattggtcttctcgtcgtaaataaattcggtgcggatgttatccggagtcttcagatcgagtggatagttgccacccagataacggtagtctttagcttgggtcttcttgacggggaaacgagtcgtatcggccggagtgggagttgtatagtgattgttgatggcagtccgggcaggtacggagccactcgccggacgccatgtgaccaaaacaaggccggcgattatgggcagtagagctgcaagtagccgaatgggtttgtttttcttttccattatcaagacacccgtgatccttctttgtttgagaaaaggttataacattcgtaatgctcgcttgataatatcttcgacagctaaggacgaatcctcggagagaatggacttgaccgctttgcgtatagccggatcggcaaagccaagcatctttagagcactgatggcttcttctcccgaagctatggtattcagagcagcatctcctacagccgtccgtgcagacaagatctcgtctgaggaggtttccagttgtatcttacctttcagatccacgatgatacgctgagcggtcttcagaccgatgcccttcacggctttcagcgcatcggcctgccctgtggtaatgagtgcggccagctcttgaggagcataggaagataggatgagctgtgccgtcgtaggcccgacaccgctgacagatgtgagttggccgaagagcgtacgctcttctttcgtggaaaagccatacaataaatgggcatcttctcggatcagttgtgtaatccaaataagtccctctttcttcccctgataggcagaataagtggtgagcgagacattcacatcataacccactcccgcacactcgatcacgaggtttgtcggcgtcaaaccgactattgcacccttgagatactctatcattgcatgctacacaaactgagggctttatgtatgccttcttgaatcactcggcgaaacatcccacaaagccttcggtcaaattacttttacatgacttttctccaaaagccacatagtgttgtttattactataggaaactaacgcaaaagtagggaaaatgttgtatcaagtccgtttgtaacagggcaatcgcatttcagccactaacgtacatctaaagctcatgattgctacattcaattatcaaaacaagtacgaattcatattgtcagagattcaagattcaaattgagaccattgcacaaagaggctgttctttctgctcgcttgttcccggtgtgtttttgaccattctcgtctgttttgcagcttggggattagtcccctttcccgcacctcgagggcaattgccctcgagggacggtcgtttagcgcctattttgcgccttgaagcacaagaagccccggcatacgcttgagattgtaggccatagcttcaaggatattccgggtatgtgtcttggctaactctcgatagcgacatcgtccgccacagaaccatcgtcgaatactaccgaaggtacgttctatcaagcagcgcgtcttactgatcatccgattgagttgtttttgactttcacttgaggacttgacctcgatgagccttgagcataattccatctatcaaaccttgacgggccaaatactccgaattcttcttgctgcaatagcctttgtcggccaaaacactaattcctcccggcaacttggacttcttgatcagctcaggtaatacaaccgtgtctgcacaattagccgaggtcgtgaccactgtttctaccaaaccctgctcgtccgtcaagacgtgcttcttgtatccataccgatagtgcctgcctttgcgtacccaacgagcctccgagtctactcccggtttgccactcttgagttcacaatgataagcctcctggctgtgtacgagcttcctccgaacgagtatcctctcgatcttcagccacttctatgaccacgttgccatcaggggcgtaaggactatccacaatgctcgcatcaacgatggcgccttgatcgatacggctgatgccgtgcttcttgaactgcttgttcagctcccgaaggagtttatccataatccccaagcgagtgagttcactacggaaacgactgatcgtgctatggtcgggggaagggaagccgaggtccaagccaaggaattcactgaaaagcaaggagtcgttgatgcactcctcaacctcgtagtcactcaaaccataccaagtctccaagagtagaatcttgaacatcaacagcgcatcgtaggcagggttacctatggcattctgtgtcttggtgtatttcttgttcagcagtgtgcgaataccacgccaatcaaaaccggcattgatttgacgcaggaaagagtgtttcatgcgatctctgcgaacctgagtgtagacttgacagtttgtttggtagccatatttatgctcttgtttatacgtgtaaaatactaaatattattgatatacgcaagcaatgcaggcaaatatgtcgcaaaaatgccgtgcaatggtctc

SEQ ID NO: 961 - DNA (genomic), 1275 bp, PORYPHYROMONAS GINGIVALIS; double-stranded, circular
  misc_feature 1...1275
  hypothetical: NO
  anti-sense: UNKNOWN
aagagtcgctattggccggtgatcaatcgagatatatcctatctgcaaatgaaggaactgtacgacatggcacctctggcgcgtgtgcctcgcaaagggctgggcccgataccgaggagtatacgtccggaagagaaagccaagcgaatgatgccgttcggctcattgggcagtcgtaccatcggcagcgtttacggatcgatggaagggggtttgtcacaagggaaaaacggtatagaactcttctacgacaagcagctcaggggagaaataggcaaagccagccgtgtgtatgtaggaggacgaagaatactgaatacgatacaggctcccaagcgtggctgcgatgtctataccactctcgacatggatatgcagagcatagtcgaagtggagttgcgcagcaagctcgaagaggtgcagggagaaagtggaaccgccatcctcatggaggtagctacagggcaggtaaaggctatcaccaatctacagcgcacgccctccggcggatatatcgaatccaagaactacgcagtagccgatatgtcagaacccggttctacgttcaagaccgtgtcgatgatggtagcactcgatgccggcattgtgcatccggaggacatcatcgaaacgggcaatggtctcttctccgtaggcaagcgtactgtaagagaccataatgcacacaaaggagggtatggcccccttacggcagctcagacgatttggtactcaagcaacgtaggcgtagccaaaatcattctcaaaggctttgcccacgatcccgacaaatacgtggaggcggtcaggcgaaccggtatcacggacaagttccgtctggaaatacccggagaagctccggccgtagtgcgcaagcgtgccgacaatcctgaccgctggtatggcacgacccttgcatggatgtcattcggatacgaaacccaaatcccgccgatccatacattggctttctacaatgccgttgccaacggtggtagaatgatgcgtccctacttcgtaacgaaagtgatggatagaggggaggtcgtacaggagcaccggccggtagtattacgcgattccatctgcaagcactctacgcttatcgccatacaggatatgctctcgaacgtagtggccaaagggaccggctcgccggtcaaaagctctacggtaaacatcagcggcattgaccggtacagcgcagatctcacagggcaaaagcggttatcgtgcaggtggcaccatgcacttggtattctttctgtggttatt

SEQ ID NO: 962 - DNA (genomic), 815 bp, PORYPHYROMONAS GINGIVALIS; double-stranded, circular
  misc_feature 1...815
  hypothetical: NO
  anti-sense: UNKNOWN
aagccgagtccaaaccgctttattaccccatggcaggtactccgtcacaccacgttacggttgggatctatcatctggccacaggtaagaccgtctatctacaaacgggtgaacccaaggaaaaatttctgacgaatttgagttggagtccggacgaaaatatcttgtatgtagctgaggtgaatcgtgctcaaaacgaatgtaaggtaaatgcctatgacgctgagaccggtagattcgtccgtacgctttttgttgaaaccgataaacattatgtagagccgttacatcccctgacattccttccgggaagtaacaatcagttcatttggcagagccgtcgcgacggatggaaccatctctatctgtatgatactacaggtcgtctgatccgtcaggtgacaaaaggggagtgggaggttacaaactttgcaggcttcgatcccaagggaacacggctctatttcgaaagtaccgaagccagccctctcgaacgccatttttactgtattgatatcaaaggaggaaagacaaaagatctgactccggagtcgggaatgcaccgcactcagctatctcctgatggttctgccataatcgatatttttcagtcacctactgtcccgcgtaaggttacagtgacaaatatcggcaaagggtctcacacactcttggaggctaagaaccccgatacgggctatgccatgccggagatcagaacgggtaccatcatggcggccgatgggcagacacctctttattacaagctcacgatgccgcttcatttcgatccggcaaagaaatatgggggccga

SEQ ID NO: 963 - DNA (genomic), 2155 bp, PORYPHYROMONAS GINGIVALIS; double-stranded, circular
  misc_feature 1...2155
  hypothetical: NO
  anti-sense: UNKNOWN
tgcgctgaattcctccacctctatagccgttttgacctatctgtttttgtgtattcatatatctcttgttccaaggagtcgatagatttctatcatgattatgaggtataagccggaataaccctcaccgatagtccaaacacagataaggcacgcaccaaattcgttgaagaatttggtgcgttccttatctattctacctccttaaattgtttttatgccatgcattttatatataaatagaatttgatttgtatatttattgaaatcagtttatatatagatcaaaaacgatctatatacaaatcgaaaatgatttatatacagatcgttttcttatctctcaaaagtcatgtttcgatctgaaaaagttcgtttctcacttttttgtcttcaaaatccgtttccatttacgtgcttatttggaatgattctaaactcatcttcattgttgaaaactttttttggcacgtggttttccccatacaggatgatacaaaacaaggagtctttttctctttgcatggtttccctaattgtttgggcgagtgagagttcatggggataacagacagtatacgaatggcttttgctgctatagggctttcaagttgaaatttttcgatctgaaaaaatgctctgacaaacagaaacttcgatatttcgcttacatcgagttcatgtcaggccggtggtgccggaatgtgtgcagctgacaaattgcttccggatatttagcattaatcggaggaatactatatttgcgaccgaaaacaagagatcacttacggaaccactattttatcagccgatcgggggagcaccaatccttcggttgccgatatcttctgtgcagatagagccgtctgctctctgtagtatgtttcccgactcatctcttgacgctgttaggatcgaatctgtggcatagaccacaaatagaaaaccaaatactaatatgaaactttcatctaagaaaatcttagcaatcattgcattgctgacgatgggacatgctgtgcaggcacagtttgttccggctcccaccacagggattcgcatgtctgtcactacaaccaaggccgtaggcgaaaaaatcgaattgttggttcattccatagagaagaaaggcatctggatcgatctcaatggggatgccacttaccaacaaggagaggaaataaccgtattcgatgaggcataccacgaatacacgatcgggacgcaaaccctcactatctatggtaatacgacccgattgggctgtcgatctaccggtgcaacggctgtcgatgtaacgaaaaaccctaatctgacctatctcgcatgcccgaaaaataatctgaaatcattggacttgacgcaaaacccaaagctgctgcgagtttggtgcgactctaacgaaatagaaagtttggacctgagtggcaatccggctttgatcatcctcggctgtgacaggaataagctgactgagctgaagaccgataacaaccccaagttggcctctctttggtgttctgataataacctgacggagttggaactcagtgccaatcctcgtctcaatgatctttggtgcttcggtaatcggatcacgaaactcgatctgagtgccaatcctctattggtaacactttggtgcagtgacaatgagctttcgaccttggatctttccaagaattcggacgttgcttacctttggtgttcatcgaacaaacttacatccttgaatctgtcgggggtgaagggactgagtgttttggtttgtcattccaatcagatcgcaggtgaagaaatgacgaaagtggtgaatgctttgcccacactatctcccggcgcaggcgctcagagcaagttcgtcgttngaacacctcaaggacactgatgagaagaatatctgtaccgtaaaggatgtggaaaaagctaaaagtaagaactggcgagtatttgacttcaacggtgattctgacaatatgcttccatacgaaggaagtccgacatcgaacttggcagtagatgctcccactgtcaggatatatcccaatccggtaggaagatatgcgctcgtcgagatccccgagtctcttttagggcaggaagctgctttatacgatatgaatggggtaaaagtctatagtttcgcggtagagtc

SEQ ID NO: 964 - DNA (genomic), 1966 bp, PORYPHYROMONAS GINGIVALIS; double-stranded, circular
  misc_feature 1...1966
  hypothetical: NO
  anti-sense: UNKNOWN
cggtggaatgtgcaaacttcaaaaatgtttgtatatatcaaaagaattcacgatatttgcttgcgagaagttttaaatatgtataatcttaaaaaaacaagaaaatgagaaaattctttttgacagtcttattggcaggagcgttttctatcgcaaatgcagccgatgttactgcagtcacttgttcaacgcctaacggaggagaaacccatgtaatggttttttgtacggacggcaggagttgtgattttatcttgaaaatacagggagatgagacagattacaacaatgtaatgagtcaagttatgcaagcagcaaagagattctgcgcttctaattttccatgttttaaagtgagtcaaaatttgaacgcagaagctcctcagacattagaacccaaaacatcttcaaatcccatccctggtagaaaaattaagtgatcattgtaaaggagccttatagtattcactataggctccccaaccctcacataatatgaaaatccaatgacgttatttcgcattttattttactttctacttactatagttggtatctattccccttctgctcaggaaataacattggaggctttcaaaacagatactcttgataaggttttccttaataaatgcatttatagggtatactaccaaactgaaattaagcaggacacttcacaaaatctccctaatagagggttaacactgctacagataggatcaaaaatgagtaaatttatcgatttctatcagcattatacagattcacttagagatgaaacagcaagaaaaaaaaatcattcgcttgccacgagtgaagtgacaaatttccagtactctctatattccaaaattatattccgaaaccaagtatttagaaattatccccaaaaggacatcaatacagtaaggattaggaactgaattcggtgaatatttcacttatgaagaaatagccccacggtttggactgggaaatttcactgaatgaagaaaaggaatatcaaaggatatcgaatgtaaaaaagctacatggtccttatagaggacggattttatcaggcttggtattcagaagatattcctatcctatggggccatatgtctttgaggcttacccggcttgatcatggagattcgagactctaataacgagtatgtttttgttgcaatggcagtcttgttgataaaaaattatgatcccatatatcgagtgaatacgccttatgaattcctttatgaaagagataaatcttggcatgaaatcaagaaaagttatcaaaatctatattttgagattgatgggaaaattctccgatcagtgacaccatacaatccaattgaaaaggattagtttcttcgcatacagcagagccttaaaaagccaaattccgcagagagttagttttcgttagttcgaatttgattcttcgaccaaggtccaatagagccttatagtttcggatagaaataggacataatcctaatttgatagcgtttttatgagacctttgaaaaataaggaaatggagggaagaggaattcttcacataaaacggggggagggaaaaggggtggcagtaaggagtgaaagtagttgtaaatcccccttgaggagctacttgcacgagctcctcaaggggggttatgccttatcctacggatgaggacataattatccccggcgttctgtataaattaaaggcgatgctttcaagaatgttttgagtatgggtcttggcaagtccccggtatcgacatcgtccgccatgaaaccaccgccgaatactgccaaaggtgcgttcgatggtgctccgtatcggaccgattgctttgtttccttgcttctcttcctcggtcaatgccctgttgcgttgtgccttgtgcatgatgccgtcttgaaggtgatgggtttgcaggtaggaacgattttccccgcaagcatatcctttgtccgcgaagac

SEQ ID NO: 965 - DNA (genomic), 2721 bp, PORYPHYROMONAS GINGIVALIS; double-stranded, circular
  misc_feature 1...2721
  hypothetical: NO
  anti-sense: UNKNOWN
cagtatcaagggaaaagacttcatagtataaagggtgggggctttatagtataaagggtagagggtttacggtataaagtatggaggctttatagtataaagggtagagggtttacagtataaagtatggaggctttatggtacaaaggacaaaggcttcatgatatgccctataggtcaaattcttacattccacagaaatacagaaaacgggtgtttttgctccattgccatatatcggtttgtatggacgacccatagtcggacaaaagctatgctgtcaatcttggcaaatcccctttctctttcttgtgcgatcgaggaggggattactgttttcagtcctcgttacggcatcttgagaggtgaatttattcgatggtagtgctgcttttgaagtatccggctatcagccggtagtagggcttataagacgataatgtactattgatatataaaaaagatggaattgtttactccggttcggtctttttatcgtttctttgtgtcagtctatttgtccgtttttcatctccggacgaaaagggggggctgcctaaatcctacagggcggtagcatgtaaggccgggcctcttccccttacaggcaaatggatggcatactaaacgatgaatatagacaagcatctatgaacaggttttcaaatcattggccctgcatcctcgtggggtttgtactctggtttgtatcggcgagtcggactgtggcacaaaacgcctccgaaacgacggtatcgtacgatacggataccgccgtactctccgaagccgatgtgcttcggatcgctcttagtgagaatgccacagtgaaagtggccgatatggatgtgcgcaaacaggaatatgcacgtagggcagcacgtgccgatctcttcccgaaagtagacctcaatggcgtttacagccatacgctaaagaagcaggtcttatatatagatatgcccggtttcagcagtagcgaaggtatcgaaatggggcgtacacacaatacgcaaggaggggtgaacgtctccatgccattggtgtcggcacagctttggaaaagcattgccatgaccggagaacagctcgatctggctctggagaaagctcgcagctcccgaatcgatttggtggcagaggtgaagaaggcttacctcagtgtattgttggccgaggactcttatggcgtattcaagcgcagctatgacaatgctctggccaattataagaacatatccgacaagttcgatcgtggacttgtggccgagtatgataagattcgagccaatgtacaggtacgcaacatcgagcctaacctcttgcaagcgcagaactccgtagcccttgctctctggcagctcaaggtcctgatgagcatggaagtggaaactccgatcagactctccggttcattgtccgactataaagaacaagtctataccggctattttgccgccgatacgcttatttccaacaactcctccctgcgtcagctcgatatacagcgtcgtctggctgtcagtgcagacaagctgaacaagtacagcttcctgcctacactcaatctgggagggcagtacacctattcgctcaacagcaacgacatcaaattctggggcgagggacaacgctggacgcctttctccaccatatcgctcagcctgtacattcctatattcaatggaggcaaacgtctgtacaacgtgaagcaaagtgctttatcgatccgtcagatcgatctgcaacgacgccacatagagcaatccatccgaatgggaatcaagaaccaaaatgaccgtctgcgtacctgtatgcagagatttgtggcctcggaagaggctgtccgaagtgcagaaaagggctatcagatagcagagaaacgctatcagacaggcgaaggcactctcgtcgagctcaacgatgccgatgtggctcttttgcaggctcgactcaattataatcaggccatattcgactttatgaccgcaaaggccgaattggacaagatgaacggcatggggattcccgaacaatgagcgtaaaaagtaaatagtaacaaaatacacctgtatgataaatatgaaaagatcgaatacactgggcagtgctatcctcctcatagtcctgccgttcctcattctcacgagctgcaatggcaagaaagagagccggccgtctgctgctgattcggcagctatggcagccaaattggtggagacgactatagtgaagaccgacacgctgaatgaggtactgagtttcacagctaccgttcgggccgaagtgaccaacaacattacccctcagatgggcaatagaatcgtacgccttacggccgaagtaggtgatcgagtgggacgcggacaggtgctcgccgagttggatcggagccaactgacccaggccaaagtacaactggagaatacgcgcaccaatttccagcgtatggatgagctgtacaaaataggtggcatagccaaacagcagtgggatgcgctcaaaacgcagctcgacgtggccgagactacttacaacaatctgctggagaacaccgtgctccgaagccctatatccggtgtgattaccgcacgcaattatgatagcggcgatatggcttctcccacgaaacctatctatgtggtagaacagatagctcccgtaaagctccgcatcgacgtctccgaacagtatttctctcgcctgaaaaagggtatgcct

SEQ ID NO: 966 - DNA (genomic), 2307 bp, PORYPHYROMONAS GINGIVALIS; double-stranded, circular
  misc_feature 1...2307
  hypothetical: NO
  anti-sense: UNKNOWN
aatcgccttcgaactcggnccccgagccctgatagctggaatctacacacttccgtacaggtctcaaaaagccataaactgcggccgtatttcattatctttgttccataatcatggactattatgaataacgatctccaatttactatggtagctaagaccctttatgggttggaggatgtcttggctgccgaactaacagccttgggtgctgaggaggtaaccgtcggccggcgtatggtcagttttcgaggagataagaggatgctctatcttgctaatctccggttgcgtacagcactgcgcatattgaaacctgtaataactttccatgcgaagacgacagatgaaatttatgaaaggctcagacttttcgattggacgaccgttatctcatcggatcaaactttctccattgattccgtcgtttattccgattcgttcaagaacagtcagtatataagttatcgtaccaaagatgctttggtggatttcttcagtgatcgtgagggcaaacgtccctctgtccggctctccaatcccgatattttactgaacatacatgtgtcgcacgaggaagtaaccctgtcgctcgatagttcgggcgatagtctgcacaagcgaggctatcgtgtggccgaaacgactgctcctctaaatgaggtgttggctgccggtatcttgctcaaagccggttgggacggtagtacggatttgatcgatcctatgtgtggatccggaacgttcctgatcgaagctgccctgattgcatgcaatattgctcccggtatctataggcgaggctttgctttccagcggtgggcggatttcgatctcgatctatatgatgagttgttccatgacgacagtgcggaacgtgtattcgatcatatcatctacggttccgatattttgccacaggccgtggctgcggccagaagtaacgtggagcgagccggtcttggcaggtatatctctctgagtgtccttcccatgcagcagcgtccgaagcctgaatccaaggctatgctggtgatgaatcctccctatggagaacgtatcaaagtggaggacatgcagcagttgtataccatgatcggagagcgactcaagcataattatgcaggttgctctgcatggattctggctttcaagccggagcatttcaatcatatcggccttcgtcagtctcatcgagaaaagttgatgaatggagctttggaatgtgagttgcgaggttatgaactctttgagggacgacgcgattcatttgccgaaagaaaaagtcgtcgagccgaaggagaacaaggcgtaggacggagaatcgaccgtcgtgacgtttctgccggaagggaaaaacgctccaactccatggatcgagaaaataagtctccttatcgttctcctcgtcctgataagcctttcagaacttccgataaaaggaaaaaagagcataatgatgagcagcaacgagaggctcgctggccgaacgataggttccgatcttcggatgaatctgaaagaggacctcgcaaatcctcttcaaagcggattcaggtgatccgcaacgatgaataataaagaatagaaaatcaaatacaatagataaatgaagaagacaatcttccaacaactatttctgtctgtttgtgcccttacagtggccttgccttgttcggctcagtctcctgaaacgagtggtaaggagtttactcttgagcaactgatgcccggaggaaaagagttttataacttttaccccgaatacgtggtcggtttgcaatggatgggagacaattatgtctttatcgagggtgatgatttagtttttaataaggcgaatggcaaatcggctcagacgaccagattttctgctgccgatctcaatgcactcatgccggagggatgcaaatttcagacgactgatgctttcccttcattccgcacactcgatgccggacggggactggtcgttctatttacccaaggaggattagtcggattcgatatgcttgctcgaaaggtgacttatcttttcgataccaatgaggagacggcttctttggatttttctcctgtgggagaccgtgttgcctatgtcagaaaccataacctttacattgctcgtggaggtaaattgggagaaggtatgtcacgagctatcgctgtgactatcgatggaactgagactctcgtatatggccaggccgtacaccagcgtgaattcggtatcgaaaaaggtacattctggtctccaaaagggagctgccttgctttctatcgaatggatcagagtatggtgaagcc

SEQ ID NO: 967 - DNA (genomic), 1345 bp, PORYPHYROMONAS GINGIVALIS; double-stranded, circular
  misc_feature 1...1345
  hypothetical: NO
  anti-sense: UNKNOWN
aaagtgtcccagctgataccggcaagcattgatctcgatctcgatcgaatcgtccaccacggcacaacgaatacagaggcgaacgatgtcatacgtttaccttgtgcattatagggagagacgcgaacgagtctgtgtaccccattctcgctcttgagaaatccgtaggccaaattgccttccacctgcatcgtcacagtcttaatacctgcttcgtctccatcctgccagttggttatcgtcacttgatacccctgcttgtccgcccaacgctgatacatacgcaccagcatggaggcccagtcttggctctcggttcctcctgcaccggcattcactttgagcacggcaccgaagtgatcctcttcggatcggagcatattcttcagctccacctcttctatcagccggatggcatgagcataggcttcatccacctcctcttcggtggatataccctccttgcagtattcataagcgagcttcacctcctcggcagctgtgtcgatggcatcgtagtagcctatccagctcttcagctctttcaccttgcgcatctgtgcctcggcacgcttattgtcctcccagaaggcaggatcctgtgtgcgcagttcttcctcttctaattggatacgtctgttattgacgtcaaagataccccctcagcgcatcacggcgctccaacagagaattcagttggtctatagtaatcatcgatgattatatgagttttgttagtttttgcttcgttcggtggccgaataacatctgccgaaaaaaacactgtgcccaagtgcactccgtatgcttccgggacagtacattggaaaacgaggctcaaaggtacatcttttcgatggcttcggcatagtgttcgttgatcactcgccttttgagtttcatcgtctcggtcagttcgcccttctccagtgtaaaaggctcggcgaggagcgtaatgtacttcaccttctcgtaagcagcaagcgaatcttgtgcagcctctattctggccatcatcaggcggttgatttcaggatttgcagccatctcgtccacagacattgtccgggcctgttcaagtccccttttgatggcagcctgtcttaccaattcccaattcggatagaccaaggcactcacatacttgaacctgtcacctatcaccgctatctgttcgatgatgggatccttggtcagcatcccctcgatcatctgcggagctatgtactttccgttggcagtcttgtacaggtcttttatcctctccagaaaataaagcgttccatccggatccatgcgttcggcattcgccgtacggaaatagccgtcaggcgtgaaggcttcc

SEQ ID NO: 968 - DNA (genomic), 779 bp, PORYPHYROMONAS GINGIVALIS; double-stranded, circular
  misc_feature 1...779
  hypothetical: NO
  anti-sense: UNKNOWN
caaagcagacagaatcatgatggggacagcaatgtccgaatattctctccatccaatgtcctccatgtcacaggcagggatgtaagccaagagtttataagacaaaagaatgagactgatcagtaccaatccccaaaaagaatgccggaagaagaaataataacattgaaaggatttggcactacccaatttgcctcgaaaatcgagtctataccacatacgatcgtaaaaatccgattggagcattctgattttctccttttcttccgattggcaaaactcctcctccgatagatagatctttcccaacccccatcgttctgcttgccgattgagcgtatcgttcatgatcggatgcaaagctttcatcttctgatacaaatccgccacatgccggtacaaaccgaatagcctcggaaatagcttcacaagcgaaaaactcaggacatacaatactgctccgcatataagagcataaacgattgtagactccagacctaagggaatatctacaggcagcgagagatgtaaagaggagaagatgattctaaagaccacgatgaaggcaatgccgggcaaaataatggcaaggaagtcataaagagaaaatttttccataaagtatcatccgtatttaatcaaagaataagatagaagtaaggattccccccttcttttagtgtcgtagtcttattcaggaagcgcaaatttagtcatattcgtccgcttttcaatggaataaaccgccatctttttccgttttccaagcattaccgagg

SEQ ID NO: 969 - DNA (genomic), 910 bp, PORYPHYROMONAS GINGIVALIS; double-stranded, circular
  misc_feature 1...910
  hypothetical: NO
  anti-sense: UNKNOWN
ccgacccgcttccagcttgggtttgctcagatagtcggccaaaggatcggcagccaccatgctgctctcttctatgtacgcaccggattctgtatcggattgcaaggccgacacatcgccttctccccaaatggcagcactgttcttcactatctgttggggggtgatgccgtgcgcttcgttgtaggccagttgctttgcgcgtcggcgtgcagtctcgtccatggtgagctgcatactgtcggtgatcttgtccgcgtagaagatgacacgcccatgaatgtgccgggcggcacgtcctgcagtctgcgtgagcgaacgatgcgagcgcaggaatccttccttatccgcatccagaatagccacaagcgaaacttccggcaagtccaatccttcgcggagcagattcaccccgatgagtgcatcgtagacccccttgcgcaggtcttccatgatacgcacacgctccagcgtgtccacatcgctgtgtatgtagccggtgctgataccgtggcgtagcaggtattcgctaagctcctctgccatacgtttggtcagggtcgttaccagtacgcgctctttcttttcgatgcagcgtgctatctcctccatcagatcgtccacttggtttgccgtcggcttgacgtcgatgatgggatccagcagtccggtcggacggatcagctgctcgacgatcacgccttcgcttctgttcagctcatagtcggcaggcgtggcactgatataaagggtccggggggtgagagcttcgaactcgtcgaagcgaagcggccgattgtcgagagcggcaggcaggcggaatccgtattcgaccagattctccttgcgcgaacgatcgcctccgtacatggcacgtatcttgcggtatcgtacatggctttcgctatga

SEQ ID NO: 970 - DNA (genomic), 4661 bp, PORYPHYROMONAS GINGIVALIS; double-stranded, circular
  misc_feature 1...4661
  hypothetical: NO
  anti-sense: UNKNOWN
acggaaagtgctcaccctcgtcacaagcgataggacaagacatattattacgatggagaaaactattggaggatgatggtttttattccccgagcacaaacnttcgaggcggtaacacccgaatattcacggtatgcgggacaagcattcggcagcttccaagccatgctgtcggacttaccggacgaactgggcgaaaccattcccgactttcatatatggagttcaggctcggccaattacacgatgccttaaagactgatccggtgggacgcgctgaggaagttcgttactacatcgatgaaatagaaaagcgagcagaggaaatgtgcaaggcggaacgtctgcatcgtgagggaaaactgcccaaacgggtatgccactgcgacacgaaggtaaacaacatgcttttcgacgaagacggacatgtactttgcgtcatcgacctcgacaccgtgatgccgaactttattttctccgactatggcgactttctccgtaccggagccaacaccggcgaagaggacgacaaagaccttgaccatgtaaacttcgacatggaaatcttcaaggcctttaccgaaggatacctgaagggggcaagctctttcctcaccgacgtcgaaatagagaatctcccgtacgccgcagcactatttccctatatgcagtgtgtgcgcttcctgacggactacatcaatggcgatacgtattataagatcaagtaccccgaacacaatctggtacgcactcgtgcacaattcaggctgctacagagtgtagaggactgcatgctgcagatgcaagcttttatcgaccaatgtcttaggtattaagctcttgacgtgtaccaatgtcagctacagacacacttttctaaagacaagaagactccaccgactttagtggctcttcgcacaatccttgcggatacgatgaagcaggacttaaagtcgcttaacgttcaagtttttgatataaaagttaatcatgaaagattatgaactcactacttgccatccacaaactttattaaagagaaacgagagaaatgcaatcggcatttctctcgttttgcaaagacgacgtactgctccggttaggacgaccttccgtccgttttaggtcgacctaatcgctctgtaaggacgacctatttgctccgcaaggtcgacctaaacgctcggttaggtcgacctgacttcttgtcagggtcgacgtatgcggtttattcccttgtagtgtgcggacgagaaggggggtacgaactggaaaacaaccctttataaatcacccgtttttcaaaggtctcatgctgtggagaagagactggtgataagtatatcctctccgatggatggaacaataaacacacatataagcctgatagtgctccgtccaaaataagcacgaataaatgtgttagagagaagaaagagaccaaggatacagtacaactattcaaatgcgatagccctgtactgtgcttaacgttcatataaaagctatacttttgcctttgaaaagactgaagtaaccgtttctttcatgaagacggtgcaagggaatccggtgcaattccggagctgagccctcagctgtaatgcttcgatgtcacttctccgaacaagaggtgatggggtggatagtcaatcgcgatggtcactgtagaagggcgtagtcccctatgggaaggccgacgaagacccgataagaagctaagccagaagacctgctttagtagatttgttctaatagaactccagggattgaggagtgtttagaaaaggcgtattctgccgattcgtcattgggctttgcatatttgattaggcaaacaggtcaatgtatcatctttcggcggttttcaagatccatcggttcgttccgatgatctctttctttgcagcatccttgtcccgctcttatgtgacattttttagtaacgattatgcggacaaaaactatcttttttgcgattatctcttttattgctctattgtcgtcttctctgtcggctcagagcaaagccgttttaaccggtagtgtgtcggatgccgaaaccggagagcctcttgccggtgctcgaatcgaagtcaaacacaccaacatagtagccggtgccgatgccggcggacatttcgagatcaagaacctgccggcagggcagcatactattatatgttcgttgggggggtatggacagaaagaggaggtggttgccatcgaagccggacagaccaaaacgatctcttttgcattgcgactgcgaacgaacaacttggaggaagtcgtcgttaccggtaccggtacacgttaccgcttggtcgatgctcctgtggcaacggaagtccttaccgctaaggacatagcctctttctcggctcctacttccgaggccttattgcaggggctgagtccgtcttttgacttcggccccaatctgatgggctctttcatgcagctgaacggccttagcagtaagtatatcctcatccttatcgatggtaagcgtgtgtacggcgatgtaggcggtcaggccgatttgagtcgtatttctcctgatcagatcgaacggatcgaactggtgaaaggtgcttcgagttcgctctacggatccgatgccatcgccggggtaatcaatgtgatcacaaaaaagaatacgaatcgactgagtgcatatacgtcacatcgcatatcgaagtacaacgatcggcaaaccaatacttcgctcgatataaacatcggtaagttcagtagcaataccaactatttcttctaccatacggatggctggcagaatagtccgttcgaaataaaaaagaaaaaaggatccggcgaaccggtcttggaggaaacgtataagaaaacttttcgtgcacaggaaaatcagggtgtaagccaatcgctttcctattatgcaactaacaatcttagcttcagcggaaatgtgcagtacaataaacgtcagatcttcactccgactttttccgaaaagaaggcctatgacatggattatcgtgctttgacggcttcactcggtacgaactatcttttccccaatggtctgcatacgctttctttcgatgccgtctacgatcgcttccgtttcggatatttgtatcatgacaaggacagcagtgagagcctgatcaacaaccaaggtcagaccgagcaacccacattctttccgggtcagctacgcaataaaaacgatcagatccgatacacggcagaggctcgcggtgtatttacactgccttatgcgcagaaactgaccggcggtttggagtatttccgtgaggaattgatctctccctataatttgattaccgacaaggcagatgcttccacgctctctgcttatgtacaagatgaatggaaaccgctcgattggttcaatatgacagccggtttccgtctggtacaccatcaggagttcggtacacgaatgacgcctaaggtatccatactcgccaagtatgggccgctgaacttccgcgctacgtatgctaacggctataagactcccacgctgaaagagctttttgcacggaacgaactcaccactatgggttcgcacaatctctatctcggcaatgcggatcttaagccacagatgtcggattattatgctttgggcttggagtacaatcaaggccctatctcgttcagtgcaacggtttatgacaatgaacttcgcaatctgatctcctttatggatataccgacctcacccgagcacgaagctcagggaatcaagaaaaccaagcagtatgccaacataggaaaagctcgcagccgcggccttgatgtcctatgtgatgcctctatcggttggggtatcaagttaggagccggatacagcctcgtggaagctaagaatctccagacggatgagtggctggaaggagctgcacgtcatcgtgccaatgtgcacgccgattgggttcactactggggtcagtatagacttggcgtgagccttttcggccgtattcagagcgagcgttactacaaagacggcaatgctccggactataccttgtggcgactcgccacatcgcatcgtttcgctcatttccgccacatcatcctggatggaacgctcggtatagacaacctgtttgactacgtggatgatcgtcctatgggtgtcaattatgctaccgtaacgccgggacgtactttctttgctcaaatagcgattcgattcaacaactaatgtctcacaaattaatttaagaacagagatgaaaaaactgattttagcgactttgggacttatggccattgccatgctctcatgttcaagcaacaacaaggatttggagaacaaaggggaggctactcttttggtaacgtttggtagctcctataaagctccacgcgaaacctatgcgaagattgagaagacttttgccgcagcttatcccgatcaaaggataagctggacatacacgtcttctattatccgaaagaaactggctcagcagggtatttatatcgatgctccggatgaggctttggagaaattggctcgtctgggttataagaagatcaatgttacagagtcttcatgtgattcccggccgagaatatgatgagatgatcgactttgttcaataattttaaggcagcacatagtgatattactgtga

SEQ ID NO: 971 - DNA (genomic), 3615 bp, PORYPHYROMONAS GINGIVALIS; double-stranded, circular
  misc_feature 1...3615
  hypothetical: NO
  anti-sense: UNKNOWN
aggaaagttcctcccatgtctccagcagtttttgcttgtaagcctccgtattctcttttaatcggctgaacgagagcttgtccgccttggtgaatacgatgctgaacggaatcccgttctcacccagccattggagaaactccaagtcgatcttctgcggttcatgcctgcaatcgatcaggacaaagagactggaaagctgctcgcgacagaggatgtacgtctcgatgatcctgcgcaaggattccctgttggacgcacccaaacgggcatatccgtagccgggcaaatcgaccagataccacgaatcgtcgatgataaaatggttgatcagctgcgttttgcccggcttttgggaggtcatggccagtcccttttggccggtaagcatattgatcagagaggatttgcccacattcgaacggccgatgaaagcatattcggggagcctcgtatcaggacatttgcgcacatcggtattactgattacaaatgccgccttttttatttccattcggttctgtcgttatttatatacggatagccgtacaataattatatctttgtgacatacaaagatagctttcttttaccggttaagcctcaattagaatatgaacaaatcgcttataattcttatctataccctcgtttgggttttgctcatcgtcttgcaaagtctggcattggagagcgccaaccccggcaccccctccttttggaatacgccctccgcttattattccgtatggatcgttgatgcctatatcatagccctgtactatatcaattattttctgatagccccattcatgatcaagaggcacctctttcgtccctatatcgtgctgtcgctggccttgggcggaataggcatgttgcttcccgtcgtcttccaccacgcttggcaatggactgtaccgggcacgtccgaaggacagatgcctctttacggggaaggcttcatcgcctccatagcggccatagccgtagggctgtccgtccgcggagtccgcgagtgggtgcgtctggctcgtcggaataccaatctggagatagcactcaagaacaagtccatcgcatacgatcgtgccgaagcgcggctgcgttctttggaacagccggtttctttccacaaccccggcacgggagcgaaagcggaaaacgcaccttcctctactcctgtcagtccacaaacaaacgaatagtcatgcgaaagaaacgctccaatccctactacaaagtcagcaggcggaagttcagcaaacgaaattccggacgcagatattcgagaaagaggagaagaaacggacggcgacgagggctgatgatcagcctgctcctccttgtcgccctcggtatctggatagccaagcgatacagggcttggttcgtttctccggccgaagtcgcctacaccgtaccgcatacgatagacaggctcaccctgacaccgggtgaggatttccttacccaaaggacggtcagctggcggtgcgacaccctgccgcaagactcttggctggactatcgctctccggacggagcggatgcagataccctgctgatctcgctgccggccgagggaaaagaagtcgtcacccgtgccggacgcaactactattaccacgctaagataaacggactcaagcccggccgcacctatacctacagggtcaagacgggagagcagacatcgccctggtaccgattctccattcccgacagttcggctgctaccgacttcatctatatcggggacgttcaggatccgggcaacggaggcagtcaggctctgctccaacgactgcgcaccctgcatcccaaccccgattttctggctttgggtggcgatcagatcgaaggccccacggatttctattgggaagtatggcatcgtgtcataggcgactggacggcatcgacacccgtcatcgccgctaccggcaaccacgagtatatcaaaggactgaaaagacagctcgatccccgttgggtacctcagtacaactatccggccaatggtcccaaaggcttcgagcggcgttcgtactacatagacttcccccatatgcggctcatcgtcatggacaccaacgacatccaatggccggcatccgtattcaaccaccgcacgtggttgaaaaacgcactcgaaaccaccgtacagccgtggaaggtggtcatgttccaccacggagtgtattcggtgcggcagggacgcatgaacccgatcatccgctacggcttccgctccattctggaggaaggcggtgccgacctcgtcctgcaaggacacgatcatgcctactcccgtatcaccaccaagacggagtccggcacgaagacgacacccgtatatatcatcagcagcgcatcgcccaagcactaccgcaacggattctccgagcagcacgacaggatcggctccggcctctacctctatcagaccatccacgtcacgcagggagagatccgctaccgctccaccaccttcgacaatcgcccgtacgacgacctgcacctgaagaagcagggaggccgaaccacagtcaaggacaatgccgaggactggaaagagatcttcgctttcgacaactttgccgacagcaaaaaaggccgtaaaaagcgtgccgactatcggcaggcagcccaagaacgagcagccggacatcggtaagcggacgatcggtggcgcgtaaaatcagatcgaaaacgaacgaacagccacactgccaacaacttttcactaccttcgttgccgtaacgacagaatagaaacatagacgatcctcggtcgaaaggtcgcgcggtcgtcgattcttcgattaactaacaaacaatgaaaaaagaagaccttatgcgtagtggctttgccacacgtgccatccatggaggcgctatcgagaacgccttcggctgcttagccactcccatttaccaaacatcgactttcgtttttgacactgccgaacagggaggccgccgctttgccggagaggaagacggatacatctatacccgtctgggcaaccccaactgcacccaagtggaagagaaactggccatgctcgaaggcggagaagccgccgcatcggcctcatccggtatcggagccatcagctctgccatctgggtatgcgtgaaggccggcgaccatatcgtagccggcaagacgctctacggctgcaccttcgccttcctcacccacggactgagccgctacggtgtggaagtcaccctcgtggatacccgccatccggaagaggtggaggccgccattcgcccgaatacgaagctcgtctatctggagactccggccaaccccaatatgtacctgaccgacatcaaggcagtctgcgacatcgctcataagcacgaaggcgtacgcgtcatggtggacaatacctactgcacgccctatatctgccgtccgctggagctgggtgccgacatcgtggtacacagcgcgaccaagtacctgaacggacatggcgacgtcatcgccggattcgtcgtaggtaaagaggactacatcaaggaggtgaagctcgtcggcgtcaaggacctcacgggggccaatatgagtccgttcgatgcttatctgatcagccg

SEQ ID NO: 972 - DNA (genomic), 5385 bp, PORYPHYROMONAS GINGIVALIS; double-stranded, circular
  misc_feature 1...5385
  hypothetical: NO
  anti-sense: UNKNOWN
gaggcacgaaccgagcctaccgtccttgtcggactgattaccctcagcaatcggaaactcaagtgcgagagtatctcgatgagttggctttcttgtgcgaaacagccggagcgcagccgatagcccgcttcacccagaaactggatcagcccaattccgtaacctttgtaggcaaaggcaaattggatgagatacgcgcctatgtgcaggagaacgagatcggcatggtggtgttcgacgacgaactgtcgcccaagcagctgcgcaacatcgaaaaagaacttcagaccaagatcctcgatcgtacgggtcttatcctcgatatattcgcccgacgggcacagacggctcatgccaaaacgcaggtagaactggcgcagtaccagtatatgctgcctcgactgacggggctatggacccacctcgaaaggcagcgaggcggtgtcggcatgagaggtccgggagaaaagcagttggagacagaccgccgtatcgtcttggacaaaatagctcggctcaaagaagaactaagggacatagacaagcagaaatccgtgcagcgcaagaaccgtggcaagatggtacgcgttgctttggtcggctatacgaatgtcgggaagagtacgttgatgaatgtcctctccaaaagtgaggtcttcgccgaaaacaagctgtttgccacgttggatacgacggtgcgcaaggtgatcatagacaatttgcctttcttgctgagcgatacggtcgggtttatccgcaagctgcccacacagttggtcgaatctttcaaaagtacacttgatgaggtgcgagaggcggatttgttggtgcacgtggtggatatgtcgcatccggcattcgaagagcaaatagaggtggtgaaccagactctggcggagataacggcaggagaagaaaagccgatgcttcttctcttcaacaagatcgatgcgttctctttcacacccaaagacgaagacgaccttactccccgaacaaaagagaacataagtgccgaggagctgcaacagacctggatggccaaactcgggaatgactgcctgttcgtctcggcgaagaaaggcaccgggatggatgctctgaaagctcttttgtacgagagagctaaggcaatccatatcacgcgcttcccctacaatgacttcctgttccaggactattcggaggagatggaataagctgttctcttgggaagtatgtgaaaattcctttagtggttctccatcggcttgcgcgaaattctctatctttgatagattgttgatcttgagaccataagtttttgtggctctgtgcatcgacgacttcgatcatcaataacaataaacgatcagtagcactgtggacgtatctgcatatcctttttttcgtcgcgatatgagttggctctcctttaacgaacgcgtgttgatggaggctgccgaccggactttgccggtttacgacaggatcaagttcctgtccatcttctcttccaatctggaggagttctataccgtacgggtggcctatcatcaggccgtcctacagaaacggcgcgacaggagcgaggccgaagaggattccgatgcggatgctcatatcctgcaagctattcgggagactgtaatcagacaggacgaactgtattatcggattttttacgatcagatcctgcccaccttggaggaacncggtatccgactgcgtacggcatgcccccactcatccggatcataaagcctacctgcgtcgtttcttccacgaggagattttccctctgctctatccgatgctgttgctgccgagcaaggtgcgtacatttatccgttcaggtagggtgtatctggctgttcggctcaaagaaaaagagacggacgaggcctacagctatgcactgctcaatgtgcctaccgacggccttcctcgcttcgtagagctgccacggctccagaccgacacattttattactactcttttctggaagatattatcaaagagcacctggatgtagtcttccccggatacgaggtgatggacagctattcgatcaaagtgtcgcgcgatgccgatttgctgttggatgcacagcgtcctgaagatctgcccggagagatccgcaagaaggtgaagactcgcaagctcggtgctcctacgcgattcatgtatgacgggcgcatgcccgacgaggtgctgcgatacatctgcagttcgtgcgacatcgatccggaggaggcgattcggagtggaaactacgtcaatctgcaagatctggctatgctgcccaatccgtttgcccccagactggagacactcacgccggagcctctcctctcgaagcatttggagcaggccccctctctgatggaaggcattcgtaggaaggactacctgattcatgtgccttactatacgtatgactatgtcgtgcgcctgctgatggaagcggccatctcaccggatgtgtcggaaatacgccttacacagtatcgcgtagctgaaaattcgtccattatcagtgcattggaagcggctgcacagagtggaaagaaggtatctgtcttcgtggagttgaaagcccgattcgatgaggaaaacaacttgcgtttgtcagagcgtatgcgccgttcggggattcggatcgtttacagtatgcccgggctgaaagtccatgccaaaacggctctcatcctctatcatacaccggccggtgaacgtccgcaaggcatcgctttgctctctacggggaattttaatgagaccactgctcgcatttactccgacactacgctgatgactgccaatacggacattgtgcatgatgtgtaccgccttttccgcattttggacggagatcccgaaccggcacgtttcagtcgtctgctcgtggctcgctacaacatgggtgaagccattaccaacctgatcgaacgcgagatagaaaatgtgaagcgtggtaagcgtggctatatgctcctgaagatgaacggcctgcaggacaagaatgtcatcacacagctctatcgggcttccgaagccggtgtggagatcgatctgatcgtgcgaggtatctgctgtttggtacccgatatgccacagagtcgcaatatacgtgtcactcgattggtggatatgtatttggagcatagccgtatctggtgcttccacaacggggggaaagaagaggtattcatctcttcggccgactggatgaagcgcaatctatacaaccgcatcgagactgcctgccctgtgctggatcctgctttacgaagagagattatcgacatattggagatccagcttcgcgacaatatcaaggcttgccggatcgattcttctctcaacaacatttacaaacacaatagcgatgagaaaccggtgcgagcacaagctgctatctaccgctatctcaaaggcaaagaagaggccactcctgctgcaaaataaatgatgaataagacccgtttcctccgtatcctgctgtcactggcagccgtttgtttctcgtctctattcctcgtggctcaacgacattcggaagccttcgagcgttggcatcgtgacaaattcagccttttcattcattacggcctctacagtgagcttggaggggtttggcaaggcaaaccagtgaagaacggatatagcgaacagatctactctttcggaatacgcgacatgaagcaatacgagccggtggccaagcggttccgccccgacagatgggatgccgatgccatagtagccttagctcggaaagcagggatgaagagtatcgtgtttacttccaagcatcacgatggcttctgcatgtatggctcggctgagactccattcaatatagtggaggccactccttcgcgtcgcgatgtgatgaaggaattgagcgatgcttgtgagcgttcgggtatgaagttcggcgtttacttctctcttattgattggcatttcccggaagccaatccgatcagcgatcacaatgctgatcggattactccggcacatcaccaatacaatatgcgtcaggtcagagagatcctcacgggctacggccctgtcagcgagttgtggttcgatatgggatcgcttacgccgaagcagagtgaagagttgtattgtttggtgcatgagctacagcccgattgtatggttagcggacgcttaggtaatgaccgagcggactttgccgtcatgggagacaatgaacttcctaccgaaccgattgccattccttggcagacggcggcatctatgttccctgagacatggggctatcgctcatggcaggagagaggctctattcgggacaaagctcgcgagaagttcgaagatttggtgcgagtggtgtgtcgtgggggtaattatctgctgaacatcggtcctgaaggcaatggctccatattgccttatgaatccgaagtgctgcgaaccatgggcgaatttctcgatatgtatggagaaggtatttacggtacggaacgctctccttttcctgaactcttgccctttggcgaagtttcggttcgtgattccatgctttatctgtttgttcgtccggatatggccggcaaggaggtattcattccggtgaatggagaatttttggaggaggtgagcaatttgaccaacgcttcaccgctcaatatggacattcgcaagacgggggttcgtatccgaatgcctgcaagtatgcctgagtcttttcttgtgctggctttggcttttgacagaaacgattttgtactcgcaggccgacctcaaggctatcccctgcatatggccaatagctctcggatatacggccatagctgctgggactactatacgggcttcaagagtataacgggcatgaagtggcaagcggtttctgctccgcgtgctattatatatacggacatggaagccggcaagacactacggctttctgtcgggagggaggaacgagaaattacattggaaggaggcaaatcagaggaagtatcgatttcgcacgacggcttgtcatggggcaaaccctatgttcggcaagtgggtggggtattcggtatgattccagacaatatccttcgaggcgactccatccctctacccttaaccaaagggtgggaagaaatgcctgtaggacaagtggagaaaaagccttggggagagattagctcctgtctgctggtgcaggatattgtatcggatagagaacagaccgtggcatgccacctgactttcggcaatggcatatatgtaacactcaatgggaaacaaatcacagccgaactgattcgggagacaggcctggctcatgaactaaccgtttgcttgccgttgcaaaaagggaaaaatcgattggcttgtgaagttatgaatagattcgggaagaattgata

SEQ ID NO: 973 - DNA (genomic), 893 bp, PORYPHYROMONAS GINGIVALIS; double-stranded, circular
  misc_feature 1...893
  hypothetical: NO
  anti-sense: UNKNOWN
cacccctctaatttataatatccgcgctgccagatggaaaaacgaaggcctccgcagtcgggtattctgctggagctgtcgctctacatcggtcagtgtcgtagtcggtcggatatatatataggtattttcccgggcattgccggcaggagacagtagcaggtaagctcccagcgaaacaagagccatcggtataaggagtagtgccgtgatccaaaggatcacagctcttctgcgtgtgcgattcctcttttttctgtgggaggcggatctgctgtaggtcgttttcttgcgttttttctgaaccatgcccaaagataaagcatttatcctgctccggagtttcgtctaaatcgttacggtcctccgtaaatctcaagagtgcatcgcttcatacgggtgtaaaaacatgcgaggcgtatctttcctttgaacaacttattgccctctcttcatatcataagacccctctaaaatacgtgccaaaaaaattttcaacaacgaagaagaatttagaatcattccaaataagcgtccgaaaggaaacggattttgaaatcgggaagatgaaaaattagacttcgtgaagcgaaaatccactattcaaaagatcgaatcacgattgatatataaaacgttttcgatttatatataaactgatttcaataaatatataaatcgaaaacgttttgtatataaatcgcagccctcaaaaagccttttcgtaaggtgataaaacagcgacacccgcccgattccttcttgaatcgggcgggtgtcgtatatgtttggagacttacagcagagctgcacctctctatatcatcataggcgtatcagctcctcatccgaatactgcgatgagagacgcttatatcagtcccaatgaatcg

SEQ ID NO: 974 - DNA (genomic), 623 bp, PORYPHYROMONAS GINGIVALIS; double-stranded, circular
  misc_feature 1...623
  hypothetical: NO
  anti-sense: UNKNOWN
acgcttttcagttcgttcacatcggtctcttcctgctcataaccgaagccctgtttgatgttcagttctacgccggacaaaccgtatgaagagagcttcgtcttcgcactgtctatctgagccggagaaacggtagcaccgatcaataccacttctatatgcttccggttgttctcttccagtagctggtcgcgtatgacctgcgtattggggatactgccgatcacctctcgcacgtacttgtgtgcgttttcctgaagtagattgttgctgaagagctgtatgctcagatagatactcggagcaatcgtacatatggcaatgaccgtaatgatccggcgcactttctgctctcgctgtttattgaggaagactttgcgtgggaacttcagcaaacgtactgcaaggaaggtagccagtgcgataaatacagaattgatgatgaagagatagaaagccccgaagaaatatgcaaactgcccagtaccaaggccgaaaccggcagtacagagaggaggcataagggccgtcgcgatagccacaccgggtattacattgcccttgcttttggtactgccggcgacaatccccgcagcaccaccgaagaatgcgatcagcacgtc

SEQ ID NO: 975 - DNA (genomic), 941 bp, PORYPHYROMONAS GINGIVALIS; double-stranded, circular
  misc_feature 1...941
  hypothetical: NO
  anti-sense: UNKNOWN
ccagcgtagtacgcagatggatgccgggtacttccgttcggatcctttcgatcagttcgtaggtctccgccttggtaatgcgcctgcgcatccgtccgagcatcggatcgctaatgtgctgcaaagccatgtcgaggtatttgcagacgttaggccgctcacgcatcacaggcaagagatccagaggaaactgtgccggataagcataatgcagtcgaagccactcgacccctttgatgtcggacaaacgtgctgtcagttctgccagacggttagcaccgtacaggtcgaggccgtagaaggtaagatcctgagcaatcagttggaactcccgagtcccatgctttacgagcatccgtacctcttcgactaagtcctccatcgggcgcgaccgatgccggccggtgataatcggtatggcgcagtacgaacagctgcgatcgcagccctcggatattttcagataggcataatgccgcggagtggtcagtttgcgcctgttctctgcctcggcataataagacttccccaaatgagaaatgagttgcttccagtcgaatttgccgtagtaagcatccacttcgggtatctccttcttcaggtcttcccgaaaccgctcgctcaagcagcccattacgtacaggctgccgatacgtccggccttcttcgcctccaccatctccagaatggtattgacagactcctcctgtgcatcgcctatgaatccgcaggtattcaccaccacgatctcgccgcataccgaagccggatcgtgatgcacggtatagccgttggacaggaactggcgcatcagcacctcgctgtccaccagattcttggagcacccaagcgtaatgacgtctactctgtttcttctcattcgccaaagagagagtccacgaattccttcttacggaagatctgcaggtcgtctatgccct

SEQ ID NO: 976 - DNA (genomic), 961 bp, PORYPHYROMONAS GINGIVALIS; double-stranded, circular
  misc_feature 1...961
  hypothetical: NO
  anti-sense: UNKNOWN
gggactcggctcccgaccggcgcggcttacccaaccgatccggcgagcaggattgcccactaccaaggcatagggcggtacatccctaatcaccacggttcctgcacctaccatggcataagcccctatcgtaataccacaaagaatagtggcattggctccgatggagacgccttcgtgcaaatgagtggggcggtattcggattttctttcaataaaggcgcgaggattgatcacgttggtaaatacacaactcggtccgaggaatacgtaatcttcgcatatgacaccactatacagagaaacgttgttctgcaccttacagcctcgccccagtcgtacctccggcattataacgacattctgcccgatgttgcaattctctccgacctcggctccgcacatcaagtgagagaagtgccatacgcgtgtaccctgaccaagcacacaaccgtcttctactatcgctgtgggatggatcataaagacctgctatcaattggcgatcaactgttcggcacgttctaccgatgaacggaatgaggcattcatctccatctcgttcgtcacacagcgacagccgtggagtacggtggcatggttacgtcctcccatcagttcgccgatagccgacaaggactgagccgtgtgttttttggagaggaacatgaccacctgacgagcctgtacgatatcctgcttccgactcttgcttttcatctgctctatctgcacctgaaatactctgctgactgcctgctggatgcactcgatggtgacttcctttttctccagtctgacagcttggcggacaatccgtttggcaaaggtcaggtcgatttccttacctacaaccaccgaatttgtgatcaaggatacgagggtgccttccagttcacgaacattgtcgcagacatttttcggcgataaagttcagcaccgattcgtccagccggacacc

SEQ ID NO: 977 - DNA (genomic), 1063 bp, PORYPHYROMONAS GINGIVALIS; double-stranded, circular
  misc_feature 1...1063
  hypothetical: NO
  anti-sense: UNKNOWN
ggctcggtaccccggcccgatacaaattggaggcacgcgatctgcctcgcttccccgaagtaaagagggatctggcattgcttttggacaaggctgtttcctttgccgaaatagaatcactggctcgtggctgtgagaagaaactgctgcgcagggtggaactattcgatgtgtacgagggaaagaacctgcctgccggaaagaagagttatgcagtgagcttcttcctgcgcaatgatgagaagacgcttaacgacaaacagatagaggctatcatggctaagatacggacgactctggagcaaaagctcggtgcgcaactccgctgacaatcaaacgaaaatcgacaaaataagaatcgacatatcattatgggacgagcatttgaatatcgtaaagcaaggaaaatgaaacgctggggcaatatggcccgcgtcttcaccaagttaggaaaggaaatcaccatcgctgccaaagaaggcggccccgacgtggagaccaatccgcgtctgcgtatcctcgtgcagacagccaagaaggagaacatgccgaaggagaacgtggaacgcgccatcaaaaaagctacctccaaagactatacggactacaaagagatgaactatgagggctatggtccttacggcatcgcgatcttcgtggagacagctacggacaataccacacgtaccgtggccaatgtacgcagctacttcaacaaacatggcggatcgctcggtacttccggcagcttggaattcctcttccagcacaaatgcgtatttcacatcgtcaagaaagacgatatggatctcgaaagccttgaactcgaactgatagactacggtgtggacgaactggaagaggacgaaaacgagatcattctctacggtgacttttcggagaactccaacatccagaaatatctggaagatgcaggctatgagatcgcttcggccgaattcgtccgcatacccaacgatacgaaagaggtaaccgccgagcagcgcgaacagatcgagaagctcatcgagcgaatcgaagaagacgaagacgtgcaaaacgt

SEQ ID NO: 978 - DNA (genomic), 714 bp, PORYPHYROMONAS GINGIVALIS; double-stranded, circular
  misc_feature 1...714
  hypothetical: NO
  anti-sense: UNKNOWN
gcggttgaaaaacggctcgaaggtaaaggccaacagcagacctgcgatgaatgtgagcagggttatgacgagggactccaacaggagcttgcggatgactcccgaacggcttccgccgagcaggcggcgaatggccgattccttgcccctgaaaccggcttgtgcgacagtcatattgacataattgagcacggcgataacgaggatgagcaggacgatacccgtcagcactttcactttggtcatattgttcgcgcgattctccagattggcttccacgaccctgctatcgaagtagcaatccggcagagagacgaagtgtacttctttgtggaaaccctgatgatagagccacataaacgcctccttcttgaatgtttcttcgaggattcgggctttgctctcaaggtcggttccggctttgagcagatagtaggccataaaactgcaattaccccagcggaaggcattctcgccactcaaatcggacagaaaatggtaattgaccacaatatccacctttttgaactggctgttggacgggattccctccattacgcccgtgatcgtatgaggaaaattgtagagaaatacggattgacccacgggatcctgatcggcgaagagcttgcgagcaaaatcccgagagatgacggctgacttccggtcgttgagcacttgcgaggggatgccattcgtgagacggaaatcgaa

SEQ ID NO: 979 - DNA (genomic), 1880 bp, PORYPHYROMONAS GINGIVALIS; double-stranded, circular
  misc_feature 1...1880
  hypothetical: NO
  anti-sense: UNKNOWN
gaacgaatcgcgcagttcgtcgttgatcgtctcgtacatccaccatttggcctgacgctgacgtttcagtcggaagaatccgttgtccgtcgtaaaatggcggtactcgtcgatcatatcccaaatatccttgatgccgatggcataatagcctgaataggtgaggactcgcggcttccatcccgattcggcctgtgggaatagccgaagagcattccgataatgcgaagccgccagattggccttgtcgatattgtctccgtccgctttattgacgatgataccatcggccatctccataatcccgcgcttgataccctgaagttcatcccccgtaccggccagttggatcagcaggaagaagtccaccatcgaatgaacagcagtttcgctctgtcccactcctaccgtctctacaaagatcgtgtcgaatccggccgcttcacacagcacgatggtctcacgcgtcttgcgtgccacgccacccagcgaaccggcagcaggactgggacgaataaaggcattcttctctcgagagagctgctccatacgggtcttatcgcccagaatactccctttggatctctcgctgctggggtctatggccagcacggcaagcttccgcccctgcttgatgagatgcataccgaaagcatcgatcgaagtactcttgcccgctccgggtactccggtaatgccgatacgcatggagcggccggcatgaggcaggcactgctctatgatctgctgtgccgtatcctgatgcatgggcaggagactttccacgagcgtgacggcacggctcaggatggttatatcaccggccaaaatgccgtccacatagtccttgaccgtcagcttcttgcgtcttgtcctattcaggtagggattgatgatgggcatattggaaacgcccttgttcactttcagtcccttatagcaatcatcattttcgggatgatgaagtagttcgtccatagttaatgttctgtttatcagatctgcgggcaatctcgcttgcagtaccgcttggcagcagctctacggggaaaagctacagttcggctttgaccttgatacgacgtagcggagcctgcggatcgttgcaaataatggaaatatcggcagctatactctgccacccctcagccttcatcacctgcggatccacagcgatccgcaatagtgtgcttccgccgggctttatctccgtccggtcgggtacggcagtcaaagccggattgcgtgtggtgacgctatgcaatcggagagggccggcaccgacgttgcgaatctctatcgcagcctttgtcgtctctccatccaactgtcccatgtccaaataggtgctgagttccataacgcctgtttgggctgcagtgagggcagggaaattgtccaccagcggcaaggagaccatgacggaatcaacggctttttttcctgtttcgggagaggttacctccaaaacgagaggctcgtccttcatccccggaggcatattgcgaggtacggcaagcgaaagattcagctctctgggctcacgagcttgcagccggaatgcccgatcgtccagcgatacaaatgaaggtagcgatacgacagcaacttgcaggtcggactcatccgtattgttcaccaccaaccgtaccaccccctcatcttcaggcatggaaatagggaaaagcaggcgagcattgctcacctgtagcggccctatcgccaagacataggcatgcggtatggcaccactgagggtcgtaaccgtgccgcttatactgagttccagcggtgaagattgcgcgttggagaaaacccgaatccgcttgacgaaagctcctgatcgaccgacaggatcgaagaggacgcggatctccgct

SEQ ID NO: 980 - DNA (genomic), 3260 bp, PORYPHYROMONAS GINGIVALIS; double-stranded, circular
  misc_feature 1...3260
  hypothetical: NO
  anti-sense: UNKNOWN
gctcggaacccaagacggaagtgcaggatgtccgtccggctttgggcagcacagcggactacatgcgctaccgcgtatcgcgacaagtggacatagaattgaggatgccgaatgaggtcatcggcatagcactttcggcaccgctgttcagttgggtgatcgaaaatatgatcaaaaatgccgtcgatgccatgagcggtaaaggaaagatcacgatcgaacttaaggagaaaggctcgtatgcagtaatagatattaccgacacgggcaaagggatccccaaggggaaaatgcgcgatatattccgtccgggctattccacgaagaccagaggttggggtttgggcttgtctctggcaaagcgaatcatagagaaatatcacaaagggaaaataagcgtaaagcaatcggagccgggtattggcactactttccgtattctgctgccgaaacagaccgatctgccataagtatacgaacgaaatatggagccgaaccgatccttttccgccccggagtacggggctttgattttagagtatattatcgcacggattccggcagagagatcggtgaaattcccaccgtcgaggaactcctgcgtaacgacaagctcagagaatccaatcaagaaatgatcgctctgaacgaatagcagttgctcttaatatccgcatctcgcagtatgcgtcagttcgccgaggaagataatccgcctccctttgcactcgcaagtctgcatctgttgtgcataaatgatttacagcattattactacatttacggagcataaatgtagccggccggtgtctttcccaatagaaatgcacggtgcagcgttataaataaatacaggttgaagttcgggcgtgcccatcgtttcgacttcttgctattcacaattgaaaaagtaaaaaaatgacatataatgaattacaactggaatttggagccgtttaccgcagaggaacgttccctcgggacaatattctgtcgggagctaaggctcgcgcccgtagtggggtgcctattggcacgcaggggaatagcttccgtagaggaagctaagcgtttctttcgcccaagattggaggatctccacgatcctttcctgatgaaggatatggacaaggctgtagctcgcctgaacagggcagtagggcgaaaggaaaaaatcatgatttacggtgactatgatgtagacggtaccacggcagtggcactcgtctataagtatttgcgcgccacgggctgctccgaaacccaattggattactacattccggatcggtacgatgagggttatggtatctcttatcgaggaattgatttggctcactctctcggaacgaaactgataatcgtactcgactgtggtatcaaagccgtcgaaaaggtggcatacgccaagtcgcttgacattgattttattatctgcgaccatcacaatccggatgaaacgctacctgatgccgttgcggtgctggatgccaaaagagctgacaatacgtatccttacgaacatctctccggctgtggagtcgggttcaagtttatgcaagcctatgctcggagcaacaatttgcccgaatccaagctccttcctttgctcgacctcgtggctgtcagtatagcttcggatattgtccctatcatgggagagaaccgcatactcgcctattacggactgcgccaacttaataaacgcccttgtctcggcttgcaggctataatagatgtatgcggtctgaagaagcgaaggatagatatgaacgacatcgtcttcaagatcgggcctcggatcaatgcttcaggtcgtatgatgaatgggggtaaggctgtggaactactactctctcaggatgctgtggaagctcaaagccgaacggccaatatagacgaatacaacgaccaacgccgtgagctcgacaaggatgtgacggaacaggccatcgatattttgggcgagctatccgatgtggacaagaagatcctcgttatctaccggccggaatggcacaagggcgttatcggcatagtggccagcaggatgaccgaacgctattcgcgcccgacgatcgtgatgactaagagcggtgatttcatttcaggctcggctcgatccgtaggagggttcgatgtgtacaaagccatcgaacattgcaaggacttgctggtcaatttcggagggcatccttttgcctccggtctgacgatcaaagaagagaatctggaaaccttccgaaagatgattacggactatgccgaagaggctgtatcgccggaactattggtgccacaaatagatgtagatgccgaaatatccatcgaagaggtcaattacaaacttctcgacaacctcaagcggatggggccattcggcccggaaaactccaagccggtctttatatcccgacaactgtatgatgccggtggtagcagggctgtaggaaaagcttccgaacacctgaagatagatgtgagagtgggatcgggcgaacgccatccggtgagtgggattgcgtttaatcaggccggtcattgcgatgagatcaaaaacggctcatttcgtctttgctacacgatagaagagaacgaattcaacggcaacaaatcattgcaactattggtgcgcgatattaagcccgaagaagaatctgctattaacggaaaaacaagatgaaaaaaacgctcacgatgaatctgggaggcaaggtcttccacatcgacgaggatgcctataacctgctggaggagtatctgcacaatttagcctcacatttcgatcgggagaaccatacggattgtaagacgatcgaggaattcgaagcctacttgtccgacatgatggtggtgcgtttgcatagcgaacacgccgtaataagtatcggcctgattcgtgaagtcatagaaaagatcaatacgggagagcacttttcttccaatgaagacagtacgactgccggatattctgcaggggccggttacagtcagaaggagagagaaacttcaggctatcgatacatgtccggggaggctccgaagcggaagttttatcgcgacatggatcatgccgttttgtgtggcgtgtgtagcggtattgctgcatatacgagatggaatgtgaatgctatccgtgtgatagtcgtgttgatgacgattttggcttctccgctcttttggatgatcattatcggttatttggccgtttggatgatagctccaccggctataactgcttctcagaaattggagatgta

SEQ ID NO: 981 - DNA (genomic), 3268 bp, PORYPHYROMONAS GINGIVALIS; double-stranded, circular
  misc_feature 1...3268
  hypothetical: NO
  anti-sense: UNKNOWN
ggctctgacaggagtacggaagagttgctcttgagtacattaggaatcagatgggtcaggagtactttcaattcattgataaaatcggctgctgaatagtcgcctcgctcgatgcgacgaagcttgtattcccattggccggtcagctcggcactcttgagcaggtcatagtcgatcgtcgctatcaaagacatacccgtaggagtagctttgagattcttcttctctttataaatgtagttgcgcttgaagagagtctcaatgatggctgctcgcgtagacggccggccgatgccattttctttgagggcatcgcggagctcttcgtccttgaccgacttgccggccgtctccatggcacgcaggagtgtagcttcggtatagaatttgggcggctgtgtcgttttctcctgcacctcgggggtgtgtactccactttcgccctcggagaatattggcagttttttctcctcgtccttgttctctccatcatcgtccgtctgcggatcggtgaagacagtgcgccagccgggctccagtatctgtttccccgtggttttgaactctaccttagctgcttgtcccaagaccgtggtctggctgaatatgcagtccggatagaaaacggctataaatcggcgggccaccagatcgaatacacgtcgctcatcctccgacataccatgggatggctgaccggtgggaatgatggcatggtggtcagtgatcttgctattgtcgaataccttcttgcttttttttagtttgctacttcgaagtggagctgtgagcagggtatagtcggagagtccttggaggatattcggcactttttcgaatacatcgtcgctcagataggtggtatccacgcgcggataggtggtgatcttcttctcatacagcgattggatggtgcgtagcgtagcatcggccgtcatggcaaacctcttattgcattctacctgtaggccggtgaggtcgaaaagtcgaggcggcagctcccgacctttcttcgtagccacggaggtaacagcaaatgggctgccagctacgacctccacttcccgacgagcatcctcgatcgaggaaaagcgtcccttggtggcattgaacaccgtatcgcggtagatggtcttcacctcccagtagacttcaggggtgaagtgctcgatctcgtgctgtctcctgacaataagggcgagagtcggagtctgtacacgtccgatggaaagtacctgtcggttgcccccgaagcggagcgtataaagacgcgtagcgttcatacccaatagccagtcgcctatggcacgagccagtccggcctcatatagggaatgaaattcttcgctgtcgcgcagcctcgcaaagccttcacggatagactcctcagtaagagaagatatccaaagtcgccgcacgggacatgtgcagcccgttttctgcaatacccaacgctggatcagctctccctcctgtccggcatcaccgcagttcacgaccatatccgcttcatggacaagcctttcgatggtgccgaattgctcccgaatactatcgctatcgatgagtttgatgccaaatcgcagtggtatcatcggtagagaactgatactccatcgcttccattcgggtgcatagtcgtgaggttctttgagggcacagagatgtccgaaagtccatgtcacctgataaccgttgccctccatatagcctttataggctttggtggcaccgagtacagcagcgatctcacgccccacactgggcttttcggcaatacagactatcatgggcttatccttgattcttaaaaacaaatgtacacttttggccattacccactgtgccttgattgaaactattaatcggccatttgcttttcacagatttgtcattagactttttcacggacctttgatttatttagctcttccccatagtgctaaaaatgcaattctatgcttcagagccagagccaacttcagagttttcttgcctacgtgtttttggatgtaaataggttagctaaaaacttcattcggattgctttgaacttgggcttcttcacagagttgatttaagatttagtcgcataaacttatatcgaactcacgttataagaataacgcgcagcaagggggaggaaaggaaggaaggaaaaggagaaagaggaatagagagaaaagcaaaatgatttttggagagagagaaaataaaaaaggagagagcctcggattcgagactctctccttcacctttttttccggggaggagggtggagatcctatccccccctctctctcacgcttcttaaaaaacggcggcgtcctactctcccactgtgacgcagtaccatcggcaccgttgggcttaacttctctgttcggaatgggaagaggtggatccccaacgttataaccacctgaatacttcgaaaaggcaatcgacatatcgaaaggccaacaaataattcctcaagctttgcggcaacaaaccaacctataccgcatccttcgggatgcacaaaagtttcgggctattagtactgctcggcttaattgttaccaatcatacacctgcagcctatcaaggtcatagtctttaaccaccctatttatggaaatcttatcttgaggccggcttcgtgcttagatgctttcagcacttatccttaccagacgtggatacccggcggtgcacctggcggtacaaccggtaaaccaggggtctgtccaacacggtcctctcgtactagtgtcagaccctcgcaaatttcctgcgcccacaacagatagagaccgaactgtctcacgacgttctgaacccagctcgcgtgccactttaatgggcgaacagcccaacccttgggaccttctccagccccaggatgtgacgagccgacatcgaggtgccaaaccactccgtcgatatgagctcttgggagtgatcaacctgttatccccggagttacctttaatcctttgagcgatggcccttccatgcggaaccaccggatcactatgctctagtttcctacctgtgcgacttgtttgtctcccagtcaagcacccttgtgccattacactctgcgaccggttaccaatcggcctgagggtacctttagaagcctccgttacgcttttggaggcgaccaccccagtcaaactacccaccatacactgtccttgcacgccgcgagttagtattccaaacatcaaaaagggccgtattttcaacatcgacttccacgaatacttggcggtacccg

SEQ ID NO: 982 - DNA (genomic), 1962 bp, PORYPHYROMONAS GINGIVALIS; double-stranded, circular
  misc_feature 1...1962
  hypothetical: NO
  anti-sense: UNKNOWN
ggagaaatctccaaacaccggagagcaaaagtcgcaggactcgaaagtattagcctacgaattcgtcagaaacggtcagtttggcacggccttttgcacggcgagcggccaatacacgacggccatttgccgttgccatacgagagcgaaagccatgcttgttcagtctcttacggttagagggttgatatgttcttttcattgctcttatattgttttgttagttatctctctctacacttcggggtgcaaatatagagactttaatttgattcgccaaagtctttcagttcattatagagcaaatgaacgggtagtcccatgacattgtagaacgaaccctccactcgctgaatggcgatgtagcctatccattcctgtatgccgtacgaaccggctttgtcataggggcgatagcgttcgagataataatcgatctcctcatcactcagatgcgcaaaggttaccagactggaacacgagaaagcccttgtctcccaccggtggctaatgcacacaccggtcaccacctgatgcgtacgcccgcttaacgtacgtagcatccgagcggcctcttctctgtcttgcggtttgccgagaatagtaccatcaatgataaccaccgtatcggccgtaatcaacaaagtactgtcctgcatcatacctttcgatcgataagcctcggctttcattcgagcaagatagagcggcaccttctcccgatcaagaccggcaggataatcttcggcgatgtccggcatggccttttgttcgaatcgaatatcaagaccggagaggagttcttttcttcgaggtgattgcgatccgagtacgatcttatatttcttcagattgtccagcataaaacaacaagatttttcgatcaaagagacttccgtccgctaccatccgaacccattcccctgtgcccagcggccttgtgctttcagcgtttgctcgatgacatcgcggacgacgccctctcctccccggcagtgcgatatgtatttggccacctgtttgatctccggcactgcatccgccggggcaacgggcaaagccaccctctgcatcaccggcagatcgggtatatcgtcccctatataaactatctcttcggctttcaacccggtctcctgcaggaggtgttcgagctgctccaccttgttggacgaacgcatatagacatgtttgatgccgagatattctgcccgtttggctatggccggactgtatccgcctgtgatgatggccagcaagaagccttgcttgacggcatattgcatggcataaccgtcttttacattcatcgttcgcataggctggccttcggcatccatagccgaaacggtatggctgatcactccgtccacatcgaagacgaatccccgtatggacttcaggtcgaatggaatactactcatgagattaaaatggggtttattgttctttcggtccgtacatcttccgaatgctatcgctaagtatccgatagatctcctgccaatccggatatgggttgagcagaccgagatgtttttgcagagtgtttgtgtcgtctcttttggccggcccggtctgagcttcggtggcggacatctcctgcaccttggccgcagtctctgcgataagaggagccagagagcgtggcggcagaccatgtgcggccagcatttgctcactcaaggcatagagatgattcgtgaaattgcaggcaaatacagcagccaagtgcagatagagtcgctgctccgatgtacagcggagaacgttcctgctaataagacgagcgacggattccagtagtcgtaccacggattcgtcgttaccttctatatatataggtatggaagaatagtccacacgacgttcgcggctgaatgtctgaagaggatagaagaccccgatctgcgcatgataagggcgaagggtatccatcggcataggggatcctctagagtc

SEQ ID NO: 983 - DNA (genomic), 816 bp, PORYPHYROMONAS GINGIVALIS; double-stranded, circular
  misc_feature 1...816
  hypothetical: NO
  anti-sense: UNKNOWN
agcacggacacacagccatctctttcttcagtttgttctgtcgcgatttgatgatggccatcaccacaataaatcccggagggaaaagtagcaaaaagacacatcccagcatcgatattcgcctgcgaaggaattcatattcctccactgccgttgctcgtggatattgcctgcgatatgaagtcagctgatagagtaccgaggccgaagcgaggagcataaagaagcaatagaatataaatatggtaccccagctcactctggaaacagcagaccgatctcctccgtcaggcttcacatcataggatccgtccaatacctgctgaacggcaagaactccctcggacaaaccttcggcatagttccccgatcgaaaatgagggatcatgcgatcatgtatgatacggctcagcagaccatcgggcaagtaaccttccagaccatagcccgtctcaaagcgtacccgccgctgatccagcacgagtacgagcaggaggccgttgttgttcttttcattaccgactccccattgacgtgccagcttcaaggtaaaatcctccaatggagcatcaccgatagacggaagagtaacgacggcaaactcaacggcatgactgctgcggatggctcgcagccgtccgttcatcacctcctcctgtgcattgctgagcaagcctgcttcgtccgtcacgagtcgagtgctatcggcaagttggacgttaggtacatcttccggcttatatacccgttgcgccgatacacatggatgcagcagaaagaagaaaaaggccgttagggaaaaaggccacactgcat

SEQ ID NO: 984 - DNA (genomic), 2153 bp, PORYPHYROMONAS GINGIVALIS; double-stranded, circular
  misc_feature 1...2153
  hypothetical: NO
  anti-sense: UNKNOWN
tccggaagtagagtaaccgcaaaatctgcaataggttgaagaatgactgctcccaaaatccatgttacaaccaaaccaatcactaacaaggaattgttgattcgctttcgagacagaggaaacagtaccatcatgactaaagcactcgtatgaaagagtgcggagaaagcgatacagatataaaaatacaaatattttttagacaaaaacaatgggaatgacgcaaatatgatgcccatggccacatattgtcgcatggaattcatcgtttcgaaatatcctctgtatatgaggaagaaagcgatgatagaaaagatgcaatctttggacatctttctcatcccgatgaacatcaggagaatggtcacaaaggataccaatataagccatgtatgaaaatccaagttcaaagaatgaaaggctttattgatccattgccatatcaactcgaaattgtgggctgttttactatccggaaattgataggcatattcgtaaattttataatcccgtcccatcccgatccttgtaccggagaaaattacaagagcaagtcctgatatccaaaagacgaagggtttgaaacgatcatcatatttatctgcaaggaacattaccgcaaggaaaccaaataaaacgaaataaggtaacatgattatctattttttctatttggatgaggcagattcgatagcggaattaccgatattaagcagggtaaaatcgctgtccgccggaagttcgtacacattacgaccgtcgatgaccaaagatgcagccatcgtttgagagagagctgaccaatcaggcattctgaattccttccattccgttacatggaacagagcctctgctccccggactgcatcgtacatatccgtggtatattccactttgtcgcccaatcttttttgtgcctctttcatcgccacaggatcgtacacccgaactctgcaaccaacttccaacagtttctcgatgagtaccagagaaggagcttcacgcatatcatcggtaccgggtttgaatgacaacccccatatcgctacacatcggccttgcacattgcctttgtaataggttgagaacttatcgaacagaatactcttttgcttctcgttcacacgttcaacggcttccaatacttccattcgatagccgttgtcttctgctgttctgatcagtgcttttacatccttgggaaaacaagatcctccgtatccgcaacccgggtacagaaacttgctgcctatacgtgaatcggaaccgataccgagacgaaccatcgaaacatctgctcccacccgttcgcacaagttggccacatcattcataaagctgatccgagtggccagcatggcattggcagcatatttggtcatttcagccgaagcaatgtccatgaaaagaacacggaaattgtttaagagcatcggcttataaaggcttgtgatcagttcgcgcgcccggtccgaatccactcccacgaccactctatcgggtttcatgaagtcatcgatggcatttccttctttcagaaactccggattagaagctatgtcgaagtcaatcagcacctcacgcttgtccaattcttcctgtataaccttcctgatcagtcggtacgatcccaccggcacggtactcttggtaacgatcagaatataacggctcatggcacggccgatactacgggcagcatcgagtacatagcccatatccgcactgccgtcttcgccggccggtgtacccaccgctatgaatacaatatcggcttccggcacggcttgctctatctccgttccgaatcgcagtctgccggctttcacattgcgagctatcattttttcaagccccggctcatagatggggatagtcccgctgttcagctgctcgattttatttctatcagtatctatgcagcgaacatttgctcccaactccgcaaagcaagtagcactgaccagtcccacatagccgataccgactacggcaatatccatattgtaatagctgattgagttcttcggcacaaaggtaagataaaaaggagaagccttatcgagagaaagtcggctatttccccgtcctgtagcaggatatagtgcctactacccgaaggacatgagatacaataaccctgcgtataattg

SEQ ID NO: 985 - DNA (genomic), 4934 bp, PORYPHYROMONAS GINGIVALIS; double-stranded, circular
  misc_feature 1...4934
  hypothetical: NO
  anti-sense: UNKNOWN
acttccatatctgcaagcgtcttggagcaccattgccgtagtcgttatcggtgggtgcacgccagaaattgggctgtatgccgaatccgtctttgaaaaactcccgaccgtccacccgataagaggtaaccaatccgctctttttgttgaaaacgaaatcgactttcgacgaaacgaccttcaattcatctccttccgtactcgtgtgcaatgtagggcctgtagcacggtaggcagttctctctgcatcgatcggaagtcggaattgatcgtgagcaatctcataccctataggaatcagcggctctgcctgtagagtctgtacgctgaagtcaacgaagtattccataccggcagtcggcctcagcccgtctacgggtacaataatgtccgatgaagtctgaggatcgatatctaagccgatgaccttgctttgcaatgctttgccattagccgaaaccgtatagcgcaggcggtatttcttgaggttggtgaagtagaaccgattcgtgatacggaaatgtcccttggcggcatccactgcttcgaagccgacgttttgatgcacatacttcacctcctgcatggcagggtgaggcgtgcggtcgggattgaccagtccgttgcaaaggaagttgccgtcactcggtgcatccactccgaagtctcctccataagcccaataggactttcctttatcgtctgtacggaggataccctgatccacccagtcccagatgaagccgccttgcaggttggggtacttgtagatagcctgccactgcccccataggttgccggtcgaattgcccatggcgtgagcgtattccgaagggatcacagggcggtcgctaccggcccgtccgataccttccaaccatttcgcatcgggatattggggtacatacatatccgtattccactcccattgggcacgttcgtagttcaccgggcgcgccatcagatcgcgatcggcctctttcagccaaagataggcctgatagaagttgtacccgttgcctgcttcattgccgagcgaccagatcgtaacgcacggatggtttttgttgcgttcgaacatattcgctatacgatccatatgaggcttcagccactccggattattgcccaaggtacccccacggcgcaggttgtagtacatgccgtgactttcgatattggcctcgtcgtacacgtagagtccgtattcgtcgcatagctcgtagaaacggcgatcttgcgggtagtgtgccagccggacggcattcagattgtgctgcttcatcagctccaaatcccgacgcatcagctcttccggcacgtaatgaccggtggcgggattatgttcgtgcatattcacccctttcagcttgatgggctgtccattgacaaagaagcatacgtagggcataccgttggcagctttttcctctatcggtttgatttcgatccttgcggaaacccacacgggacggtattacctcgggtgactttccctttctctcgtaccgtcatcaagagcttatagagatagggatgctccgacgtccatgtatgtaccgtacccggctgtgcttcgaaagagagggtacgctctccgccggcagctatgagggtcgaacgggtttcggtggcgatggtctttccttcggcatcgagcaattcgtatgtcagagatagctcggaggcttcgccacggcggttgcgtaagtcggctttcagggagaatataccattgcggtagctatcatcgagtgtggatttgatgctgaaatccttcactgccgccttgggttgtgcaaagaggaatacatcgcgttcgatcccactgatgcgccagaagtcctgacattccagatacgagccggtactccaacgatagaccttgagcgtgagcgtgttttttccggcatggacatagggattgatgaggaattcggccggattcttggagtcttcgctgtagcccgcttcgtgtccgttgatatagacatagagtccggacttggctccggctatatggaggtagatatcgcgctccatccagtccgtgggtacttctatctcgcgccgatacacacctacggggttggcttccggcagtttgggcggctgcggattgcgaggctgaaactcgtatccgtgattggtatagatggccacaccgtgcccttgtatctcccagttgccggggacttggatgtcgtgccatccctttgtatttgccgagctatccgttatgccggcaggcagatgtgcctcgctctcggcataaaagaatcgccacgtgccgttcagaagacggtagtacgaactcttctcatacttgccggtgagagcttcgcttcggtcggcataggtcataaaggacgaacgcgccggttctttgtttacgcttaccgtacgaatatccttccaatatggaagccccgactctgtgacctgtgcctctgcaccgaaaacgacacttgcggcagtcaaagttgccgcaagtgtcaataggaaattcctcatactccgattgtctttactctgccattgcgtgtcgatagccctttactttatcccaattgccacgtgtgaaatcggggatggctacaggggcagagccgttttcgatggagatgcggcttagctccgccagacaacaccattcggccagatcgtacacatccatatcgaggggcaggccattgcggaggcaatagatgagacggtaatccatgatgtaatccatgccgccgtgtcctcctactttcttcgccgtctcttccagctcgcgatggatggggtgtttgtatttttccatcaaagccttcttcacctcctccgatacggggccgtgagcattgagcttttcatgatcgggtgcaatgtcagagtccacctgtgcggggcgaaggcagtacatctccagaggatacttgtcggcaaatccgtcggtacctacggcttggtacttgcggctataggggcggggtgtcattacattgtgctggatgagcagagtcttgcccttttccgtgcggatgagcgaagtcgtctggtcgccgttttggaagtcggccaccacctctccggtcttattcttgatgtatgcaggcccgttcacagcttttgtgtccatggctacgatggtcttcatgcggtcgccgcgatggatgtcgagcaactggcatgccggccccataccatgtgtggcatatacgtcgccacgatgtttgcggttgtagtccagacgccagttgttccagtaatagggccagaagtcttcgaggttgtggatataggcaccttctgcatgcaggatctcgccgaatacaccctgatgagccatattcagcgtggtcagctcgaaaaagtcgtatacgcagttttcgagttggatacagtgtttacgtgtgcgctccgaagtgtcgatgagcttccatatctcttccagcgtcatggctgccggcacttcgatagcggcatgcttgccgtgctccatcgcatatacgcccatttcggcgtgggttttccagtctgtgacaatatatacgaggtcgatgtcctcgcgttcgcatagtttcttccaagcatcctcactgccggagtatgctgccgcttcgggtagtcctgctttgacgaggatctcttgggtttttttcacacgttcggggagcacatcgcacagcgcaacgatctgcgtaccggggattttggagaatcgttccactgcacccggcccacgcataccgagaccgatgatcccgatacgcaccgtttccagtttgggtgttactaactgcaaaacgtgcttctgccccgatgagcgagcaggcgtttctacttggatgggggcatgtccggatactgctttctgggcatgaagagctgcgcttgcactcagggctaaacctatgcagagcgacaaaaaaactttgtacaccatatttataaggatttcttttgcggcaaagataaatctaacccaccgcaacgacaaaccatattcctgcacctctgtatgcatactcgaaagggtgtttgcccggcaggtttatgcacagatgcgaaaggattcggtgctgcactgatgcctttgcggaggcggatactttaccggaacactcgtttgtgggaggtagtatccacgacacaggtcacagcaataaaaaaaataatcgttcccggccggaaaaagttttttctgcagtacggaaaagttgaaaaagccataatccaattctttattcaaaggtttcggatatataaacaaagctttcgtatatgtgtacaaaggctttggatacatatccgaaggctttggatagagcttttccggccggaaaaattatttttgtcggctgtcggggaaacttttcccggccggaaagaaaacaatcgaacggcgacgagtaaaaccgatatagacctctgaaaaaatgagggattgtcaataatttttttcaaaggactccaaaagtgaaattttctcgcgccacattttttggggatcataaatggactttttcttgtttgtgatcgagtccttttatgagtggagtccatcgggtttgatcgggcgtactgcaggaggaagaccggcatactgccttgctgctatttctcgtgtagatgaaaagatagccaagagggctatttgtgtatctttgtctatatgaaatcatttgcagagttaatagaaaatcgccgctctatccgacaattctccgaagagcagcttttgcccgaggacgtgcaggctctgatgacagcggcactgcgcgctccgtccggcaggaacaggcaacagacccggtatatactggtggaagaccgtgataagctgcaagtgctaagcctgatgaagcagcatggctcccgttttctggcagatgctgccttggctgtagtggtactgggatcgcccatgttttccgagcgttggc

SEQ ID NO: 986 - DNA (genomic), 1386 bp, PORYPHYROMONAS GINGIVALIS; double-stranded, circular
  misc_feature 1...1386
  hypothetical: NO
  anti-sense: UNKNOWN
taatttgatagcgtttttatgagacctttgaaaaataaggaaatggagggaagaggaattcttcacataaaacgggggagggaaaaggggtggcagtaaggagtgaaagtagttgtaaatcccccttgaggagctacttgcacgagctcctcaaggggggttatgccttatcctacggatgaggacataattatccccggcgttctgtataaattaaaggcgatgctttcaagaatgttttgagtatgggtcttggcaagtccccggtatcgacatcgtccgccatgaaaccaccgccgaatactgccaaaggtgcgttcgatggtgctccgtatcggaccgattgctttgtttccttgcttctcttcctcggtcaatgccctgttgcgttgtgccttgtgcatgatgccgtcttgaaggtgatgggtttgcaggtaggaacgattttccccgcaagcatatcctttgtccgcgaagacggctgtgccttgaggtatgtttgcaccctgcaatagcggaataaactccttcgtgtcactgcgattcgctgctgtcgttatcaccttttgaacaatgccttgaacattggtcaagacaatgctttttgtatccgtagtgataacgcttttgtttgtaacccaacgggcttcttcatccgtccctttacgctgacggacaacctgtttttgataatcctcctctgcctctttttcctcctcgctccgattgtcttctctgtcgtctgcgacttcaatcgtaatgcttccgttgggttttatgcggcgtctccacaaggcttgcatcgacaagcaccccttccctgaccgaaatgtgatggcgggaaagttgtttgttaaactgcgccaatagtttgtccatgaacccaactctgtcagtgccgaacgaaatcgactgatggtactgtggtcgggagaaacctcttccatcttcagccccaagaatcgggaaaaggtgattgaatcattgatgcgctcctccaaagcacaatcactgaggttgtaccatgtctccaaaagcaacatcttgaataagagaatcacgtcataagccggggcgccgatggcattttgtcgcttggtgtatttcttgttgatcagcgtcctgatcggacgccaatcgataagcctgtcaacctgattgaggaagtcgttttgtgctttgcgataacgctttgaaaggagtgcgtctgcaaatgttacatgctcatcggtattcttggattggtatgccatgggaggaatattatgctgtttttaatactcaaatatacaaaataactccctattatacaatgaattaacaaacaaaatatacgccaatcgccgtgcaaaggtctccatataggctttgattttgttgattgtg

SEQ ID NO: 987 - DNA (genomic), 933 bp, PORYPHYROMONAS GINGIVALIS; double-stranded, circular
  misc_feature 1...933
  hypothetical: NO
  anti-sense: UNKNOWN
cgacaccgaaatgatcttttcggaagagcttctctccgttgataacaggcaggctgcccgtaatctccatccccttttgtccgggaatcaggcgttgtgcgtacaaaggagtggccattacgacgacacagacgagtaaaaacagacacttcttcatcaccatcggagtttcaggttatcgattcgttcggctcgcaacaggtcttcctgctgcacgcagaatgtcagggttcgtccaccgttacgctcgtaaagcgttacttccagctgcttgtcttcgggcagggagaactgctccagcgcaaagaccggtccgttcggacgtcttccccctgatccatgccacctgatggcaggctcgaagcggctgcaaaacctgctcctgaatcgctgtgcgtttggccaccttttatccaccacttgaaggtgatgaagtccaccgagcagggtatattcgtctgattttcgataacgacgtggaagaaaagcagcccgttgtgtgcatacagtcctcgaaggagaaactgcatgctgaaatgccgcgcaccgatgtgcttaaccgttcgcttattatgcttgtagatggtttgcatcatcagcttcacaagtacaggcgactcgttgcccaattccttgaagtagatgtcggcacggttcgaaggcaggcgtccttctccggaatacaggaattgcgcttcgcgcctgtcctggctgccctcggcatagccggagcaagctccgntctgccctcgttggcacaagaagtctttcatctccacattgagtttctccggctcttcggcatacttcacattgtaggagtaaaatgaaccgtcttcacaaatgaccgacaggttggtctncgtttcaaaattccgtacggcagccttgacacgcagcacgttttcggcatcttccgcttttccggtatca

SEQ ID NO: 988 - DNA (genomic), 1029 bp, PORYPHYROMONAS GINGIVALIS; double-stranded, circular
  misc_feature 1...1029
  hypothetical: NO
  anti-sense: UNKNOWN
cggatgacgaatttacagtagatgtacacatcgctttccccagcaaggtgcttagcaatcaattcgcttctttggaaacattgtcggatttcgaagagcagattgcaggtgctcgcacctttgttttcgtacgggaggtgcagatgcttctggaggccaatctgatcaaaggcggcgatttggacaatgctttggtgatctacgacgagccattggcacaagatcgactcgatgcccttagtgatatgatgggagtggagcggaagcaggtcaatgaattggggtacatcaacaacaagcctctaatctacgacaatgaaccggcacgccacaagctcctcgacgtattgggcgatctggctttgatcggaaaatatattcgcggacgcattattgccacctgtccggggcacagcatcaacaacaagatggcgcgcctgattcgcaaagaaatcaaacagaacgaagcacaggcccctgtctacaatccgaacaaagagccgatcatggacatcaatcggatcaaagagcttctaccccaccgctatccgttcctattggtcgataagatcatcgaagtagggccggactatatagtcggagtaaagagcgtttccggcaacgaaccatttttccccggtcacttccctggtgagcctgtgatgccgggagtcctgcaagtagaggcaatggcgcaggtgggagggctcttggtactcaataccctgaccgagccttcgagctactccacatacttccttatgatcgacaaagtgaaattccgccgtaaagtggtacccggcgacactttggtgttcaagctcagaatgatttccgagatacgcagaggagtcgctaatatgcgcggcttagctttcgtaggagagcagttagcctgtgaagctgaatttatggcacagataatccagaataaagaatgatgtcagagacaaaaatcagtccgttggcatgggtggatccgcatgccgaagataggaagtaggtgttgagataggtcccattgccgtc

SEQ ID NO: 989 - DNA (genomic), 1424 bp, PORYPHYROMONAS GINGIVALIS; double-stranded, circular
  misc_feature 1...1424
  hypothetical: NO
  anti-sense: UNKNOWN
ccttgcgtagcgtagagtccgtatggttccgttggaataaatatatctgatgtttgaggtcatctgggcgattgttttggggggtagcagagagcaatccgatatagggatatgccccctctcgcagcacaatctgctcaatgagggtgtcgagagactgatacatctgagtatgattgttgcggagtcgatggctttcgtcgatgagaatcaggccgtagttggcgcagggtagtggctcaataaactctccactatctagctcctctagatttagctcgtcttcgtcctcgatatcatctacgagcttgcctatgctccccatggtaacgaagtcgatcgagggagctatggactctggtttgtctacatcaaatagatcaatggtttctcgccatgtttctagtattgcaggaggagtgatgatcagtacccttttgttgcgaccatcatcttcgggcatagataggaagtgcttgacgagtaatgtgcccactacagttttgccaagtcccacgacatccgagagcataaatcctccatgttcctgcatgatgctatagcactgcttgaccgcgtctagctggtactcgaaggcatcgaaagtgctaggtaggtaacccgttaggatctcgttgagatctttgtcgactagagagctgaacttgtactgtagtaacttgatatacagttcgtatggagatagtgattgctcctgcatctcttgtttggcagatttcatggtctcctgagcaataggtgcagtcttaataacttgctctagaaactcttggctccagtcttcggctatagtccatttttcatcaaaccaatgactatgtcccttggcagcagatcccttttgaggtttagcagttactactcgagaatcactctcgagataattcaactccgcattccctattaaccctcggcttgtaaagttagaactgccgataatccctagagagtcgtctacacccgagcaaatataacacttggagtgtaggaactcaatctcaccctgagcatttcgtagataaatacgtatttgtattttgctagactcgcagtgcttgagcaatagtttgatgacttgcatatactcctcatggagctctagattgtgtatatcagtacgaataaaatcgtgaggaaaagatgcgtcttgatacttcggatttttgagtaaagaggagtatacatacggatccttacctatgaggatctgcaacatagttccctctctctctagaaaggcagatagttcctttatcacaagtgccatacctgggacatcccaatatcccgtggctattcgaactcgattgacccaatccaatctaaaacattgtttcagacaggaactcatagaaagttcgggcgaagaattatcaattaagggattgcgtaatagcatagtg

SEQ ID NO: 990 - DNA (genomic), 2849 bp, PORYPHYROMONAS GINGIVALIS; double-stranded, circular
  misc_feature 1...2849
  hypothetical: NO
  anti-sense: UNKNOWN
gtacctggcactgtatggtaggcaatgccaaaagatggcggtcggacgacttgcagatggagattccttctccgcaaggaggtagcatcttattgacagcttctcacgatcctgcggcagatggatgcatccgtctcagctgggaaaatgatcattacacctttggcgaaatccttgaaatggccggcatcctccctattcccccctatctcaatcgggataccgaagaggaagacttggaaacctaccaaaccgtctatgccaaaaatctgggttcggtggcagcacctacggccgggttgcatttcacggaggaggagttcgaacggctgagagcacagggtactccggttgtcgatgttaccctgcatgtcggagccggcactttccgtcccgtcaaaagcgagactatcggtgaacaccggatgcaccgtgaactgatagtcattgagcgctcatcgctggaagccctgcgtgattggcaaggcagcatcgttgccgttgggacgacctccgtacggacgctcgaaagtctctattggctggggagaagcctctcctccgcttcgcatacatcgcaagaatccttaaaagtcaatcagtgggaagcctatgagaatgaagatgtggccctgtctcgtagtgagaccatccgcataatactcgattggatggacgagcaaggagtcgaaacgctgatttttccgaccgagattctgattgctccgggctatcgctatcggatggtcgatgccatgattaccaattttcatcaaccgcgcagtaccctcttgctgcttgtctcggcttttatcggagagaattggaaggctgtttaccaccatgccctcgaatcgggctatcgcttcctgagctatggcgatggttcattgctgatcccctaaaggcgatttctcaatctttcaaaggctatttccgcgctgtttctcgaccatgcgcggatatatagcatcccttccggcctgaacatcgacctttattctttgcaatatctccaataaaacaggaagagagtgtgtcgaaatcgcctcgaaatagcgatttattgacacactctcttctttttgggtgcggctggcgagactcgaactcgcacgccgtgaagcaccagatcctaagtctgacgtggctaccaattacaccacagccgcataccgcacctgctcgacaggcttagcgagcacaaatatacacgaatctttggattatgttccagtatgtttttattagattctctaatctgagcaattcaaaaggaaaaaagccgcggaacagatgctttccctttttattcttctccaaaatagtcactatcgagctttttcaactcataagtctgttgtgtagtgcatccaaggttgtaatcgatcattaattgagttagttgttccccatcaatcaatacaattttagtctcattcctgggtgtataagttaatgcttcctttgtaaaatttgaagttgttataaagatcccttttttggcaccttgtccagcgagtgctccaacaaacttttgaagctcaggtcttcctaccacattcccaggcctccagcgcttggcttggatataaataatatcaagtcccagtttatcttcttttattgttccgtcaattccctcgtctccacttttgcctaatgctttaccggcatccttgatagaacctccatatcccattttgactaataattcgacaacaagcctctcaaaaaaagcaggtgaaaggtcaatgactttattaagtaattcggaagccaatgattttctgattctttgatatgctttgtcaaggacctcttcaggtgtttgttcgtgtattttttctgttatggattcttcttctgtttcgccgtcatttcgataaccgttctgaaattctataaacgccggaaaccgtcttaggtattttgtgtctatttttgggggattcttcgaaagtatctctctgccaaggtcagaaattataagaatcgctcgtttaggcgaatcaagaaggccagccttctttaggtatgttcttgcccagccaacgcgattgtcaaaaacagctttggagccacttgccaagagttcctgcgttcttcgtccgtgacctcaaattcggctgccaaatgttcgataatatctctgtatttgtgctcttgtccatctgaaacacatttcagcaatggaagcatcagggtttggaaatctggtatcatatttctattgttttctccattataaaaacataatttttctcttgaccaatgagcaactcgaaatagtgaagttggtttgactttgcgaatatactttatttggagatgttatacatctttttgcgtgtcttgtggactatacatgcgttgggtgagtaatcatttataaagtctgactattaggagttcggaatctcttcctgtcctgaaactctatatacttctaaaagcaaaatatagacctttatcagtattgatggagaatccaaaacacacacgaaaaaagttttcaacaacgaagatgagtttggaatcattccaaataagaacctaaatacatctcaattttgaagtcaaaaaggtgagaaaaggatgtttttcaggtagaaacatgacttttagaagagaagataacgatctatatacaaacggtttacgataaatatatagttcgtttgcgatttgtatataaatcgttttcaatttatacatagatcgaaactcatttctatataaatcgcaggctgaaaaaggtcggtttgggcagtgataaaacaaaggcacccaccaaattctacagggaactcggtgggtgccttatatgtttgaggagagggtaccga

SEQ ID NO: 991 - DNA (genomic), 758 bp, PORYPHYROMONAS GINGIVALIS; double-stranded, circular
  misc_feature 1...758
  hypothetical: NO
  anti-sense: UNKNOWN
cgaatcgagaaggtgagtttgaacttaggggtcccccccgtaagcacagaggtttggggaatgacccatgatgcgaacggtctccctttcgaaatacctatctctttcagtcgtttcaacagccagggagatatagctaccacttattacatagcgaatagcgaggcaactttgaatgaatggtgcgactatgcacacccgggcggcatcgtgagggtagaaggtcgtttttggaaaatgacttacaacataccaacctacaatgcagtctgcacccggattacattcgaaaatcaagaaatagaaggaacgatcgtcttgatacccaagcccaaagtctcgctgcctcatgtgtcggaatcggtgccttgcatccgaaccgaagccgggagggaatttatcctttgcgaagaagacgacacctttgtgtctcacgatggtaacgaagtaacgataggcggtaaacctttcttgctcaataccaacgtaaagattgtgggggacgtatctcaaaagtatgccgtgggggtaggagaaattcgattcctgcagatttgtgcccaaacagtatcacaacaaaaatgaacacaagatgaaacaaacaatacttggcatacagctgtcacaatggacaaagtgttttctttcattcttcctgattgcaggatgtacaggagcattatcggggcagtctccatcacaatcgagaggatacgcgacaaccggcatcttagagcctgtatgctgcccgacacagt

SEQ ID NO: 992 - DNA (genomic), 769 bp, PORYPHYROMONAS GINGIVALIS; double-stranded, circular
  misc_feature 1...769
  hypothetical: NO
  anti-sense: UNKNOWN
ggggacgatgtcgtcgaatgtatagttgccgaagaaaacaatgttgaaagctcgctgacttttggcatcgaagtccgagaacatggccatcacattgttggaatagctcggcttcagaccgggattgccttccgtcacgaatagcggattcgtgatgtcctgaacgggagcgatctgattgatggatggttgtgtcgtgcgtcctcggtagtccactcggaggttggtagtcctgctcggtttgtagttgattcggagcatcggggagagattgacacgattgaaagccagtttgtcctgctctactccggctacgctccgatagctgacagttctgttgggatccacattgaatcctacggtgtagtcccacgttttggcaatcttcttgaggttgagtccgatgcgatactgggtgaactcgttactgtaggagagtccgtactgactgtctaatatggagtattgcccgtcatcgcccagtcggtacacctcacgatccgaattgcgacgggagaaacgtctgttcagaatcgcttgtgcgaagtagtttttacccaacggttccacatacgagaggcgaagccgatattgcaggttggagttgtcgttgaattgcttttgattcgtctccacgctttggagcacagcctgatatatgccatctccgtcttcgtcggtcagaccgccactgacggaggcactgatcgtacggccttcgtcgttgagcttgtgactgatatccaattctccgttcagtctgaagttg

SEQ ID NO: 993 - DNA (genomic), 3431 bp, PORYPHYROMONAS GINGIVALIS; double-stranded, circular
  misc_feature 1...3431
  hypothetical: NO
  anti-sense: UNKNOWN
gaaggatgggatcttcgggcctcggctactacgatttgctcatcggtatggacctgaccgtctttccctcctactatgaaccgtgggatatacaccgctggaaagcatcgctttcggtattccgacggtgacgaccgacctttcgggcttcggcctttgggctatgcaggagcgcggtagtcggaacgacttcagtacgggcgtagccgtcatcaagcgtaccgacgacaattatgcagaagccgtacaagccatcgctgacctgctatatcgttggccggccgaaagtacagacagaacagcctgccggctggcagccatgcaaacggcatcccatgcagagtggcgtttgttttacaaccggtatgaagaagcatactctgaattgctcagtcgagattgaaaacaaccgataatgaaaaaaacgcatctttgtagtccattccacgaacaaacagctattataaaacaatgatattgaacatactgcttctaattatcggattggctttagtcgttggcggagccaattttctcaccgatggcgcagcctccatagccaagcgatttcgactatcggatttggtcatcggccttaccgtactggccttcggcacatcggctcccgaactcaccgtcagtctgatggcagccctgaaaggaagtgccgatatagctatcggcaacgtcatcgggagcaatatctttaacattctggccatcgttggcattacggctctgatcatgccgctgaccatgtcgaacagtacgattcgtatcgaaatccctctaaccattctctcctccgcggtcttgtttttcatggccaacgaccgcctcttcgacatggccggagagaatgtgatcacccgtaccgaaggtttcgtattactggctttcttcctgatatttctattctacactttcaatatgtccaaaggggaagaatcccccgggcaagtgaggcagtttgccctacccctatccataataatggtaataggcggtctggtagctctcgtcttcgggggcgatctgttcgtggacaatgcagctatgcttgccggacgcatgggagtaagcgaatcggttgtcgccatcaccatcgtagcaggaggaacttccttgcccgaattggtcaccaccttaatggctggcatcaaagaagcgtccgggcatggccatcggcaatatcgtaggtagcaacctcttcaacatcctgctcatcctcggagtcagttcgtccatcagccccatacggatccaaggcattacggtcgtggactatgggattttcattctatcggcaatcctgctctacgttttcggccttttcttcggagacaaaacgatcaaacgcttcgaaggcagcatcctcttatcgctcttcatatgctatacggtctatttggtcatgaccgcctaaagaaagccatacggggaaaaatgcgcaagaaaaggctcgacgccattcgccggcatattctgcggagcgaaatctccacccaagaggaactgcaaacagccttgctgtccgaagacattcccgtatcgcaggccacactttcacgcgatctggaaatcctcggcatagaaaaatcggcctcgccttcagggaaaaaagtgtacatcctgcctcgagacaatcgtccaccctcctctcgcggtgaacttcgtatcggacgcaccgaagggtttatcggaccggtcgatacaggagagatgcttctgctcaatacggctgagggccatgcagcccgtatcgcatcggaaatagaggagctgtctgcgcccgaagtggcggacgtattcttcggcccgacgcacatcgttgtcatcgggcagaaaggaaccacacgtcaggctttactctgcgccattgctccggccattcccgaagtcctccgctgaaaaccgacacacctcctctcggcaaaccttaccaaacttcctacactgtatagtcacgaagactgaacgacaatgagtgatgacaggaacgacatttccatgagatcgaacgaatcaacaagtatttgctctctctcaaaagactattcccctcgcatatcaaaaacacatcactacaatcaaacttaaacgggagcattttgaggcggttgtcccctgaggtctattggttaatttcatctatgcagcaatatttttacatatctttgtcgcgtttcagttgaacatcttcaaagaacacattccgacacctttggacattacatacttctactatgatcctctaaacggtatacaatctcaatccaattagcctcctcgtctacgaatgttacttataaatcaaagtcattagcaatacaaaaaaatactatgatcgaccttttttcaaaattacgcaactcggattgcagtcttcggcagaatgcctctaacacctatgtccaccgcctgctgagccgcagctatctgctgtttttcctggcctttttacagcttattgtcaatgaatcctatcgccgagtattggtctcttggaatatggaggttcgatttgcggatattctgattgccccgattgtttggagcttggtcgtttatttattacttgcagccatcccgagccgtcggttatatcgaggcattatgtggcccgtgatcctgatcgcaacgcttatgtacgtagtcgagatgtacctgctcaggtgctacgggactgtttttatcccctatatagctactgcatttcttgctactacatcagccgaggccagtgcattctggcgagaggctttctcttggagcgatattggtcatgtcgcaggttggtatgcgatcgtttggcttgtgagtctaaccctcggtcggctactacatctactcccaagcagacctaaatttctctttcctctactgcttctgtttcttagcccaatactctatgcagcagtttggcactatcccaaagctcttgatcagctctccgaagatagaggctatgctttctcctatccgacagctgcaccttgtgagaggttggtatggagcatctcgcaaagcttgatggaaggcaaagagatcaatgcccttttcgatcgcattaactccagtacaaagagagatatggttaccaaagtctcccctaaagcgccacacacggtagtgctcgttctgggtgagtcagcccgacctgattatatgcatagctatggttatcctctggagaataccccccgattggatagtctgcttgcatccggtgctgctgtacaattcgacgatgtggtcagtgccaagcctaatactcaaggttcgattgcagcgatgatgtctattggagaaagccgtgcaggaggaaaatggtatgacgatcctatgctgataccgctactccgctccgccggttactataccttctggctgagtgctcaggaaaaactgggctttgcagtgcaaaatgt

SEQ ID NO: 994 - DNA (genomic), 797 bp, PORYPHYROMONAS GINGIVALIS; double-stranded, circular
  misc_feature 1...797
  hypothetical: NO
  anti-sense: UNKNOWN
gggctgatggatctgaggctgaaagccaagtcgatccgagcagctcacatagctattgatcccgaagccaaacgagtagtgctggggcggtggcaactattcgataccgacatcgcatacttcagtgcagatacgacggcagccgatacgactcagaaagagccattcgactggcaattcgagttggacaggctggatctgaagaatatatccgctgaagtccggatgccacttgacagtgtactcctcaagacattcgtcggaaaggcggcaatagcgaagaccaaaatggatattgcagacatgctctatcaggtcggcatggcgcagttggaccggactgttttgtcttacgatacggacgagggggaagcttcgcccacctctttcgactatcgccacattgctttgaacgatgtttccctccaagccaaagatatttgtttccacgacggtgatatggagcttcagttggtcaacggatccctacgggagcgcgatcggttcgaactacagcggttgtccgggaggtataggatggatcgtttcggtttccttctgacagacctttcccttgccaccgggcacagccatatcaacggagaagtccgactaccatggagtatcttcgaaaaagatccgacagccatgatcaatctctctatggatgcttcgatcggattggaggatgtaaactatttggccggcgataatttccaactaccctnacgcaggttagtgcgttatccccggactccggtggatatagtgatacatgcacaggcacactcgatgaa

SEQ ID NO: 995 - DNA (genomic), 4400 bp, PORYPHYROMONAS GINGIVALIS; double-stranded, circular
  misc_feature 1...4400
  hypothetical: NO
  anti-sense: UNKNOWN
cgggaggttatggcttgcgccatcagtccatcgaagaaagcacagtcccaccgtatcacgaattgctgctgcatcagcatcagggagctgacgatgatattggcgataatcgcatatgcggtcatcgtatccgcattgctttccctgtagaagagaaggccgtacaatatgaacaagaaggaaaagatgaaagtactgcgaaggcgtttggagcgcaagatgagcttgatatgcagtgctatcacctcgcctatgataccatgctgacgcacaaaattcagattgtggtaccgctccgtgctgttggatttggtgcgctctttagcatagcgatgctgtctgaaataccgctggctcgctatatatgttccggccaatatcgatgccatgcagatccatacgatatataccggaagggacgagacgaagcggaacaggcagtccgaccaaggcacgaatccggtgatttctgtggcgagcatgagggctatggcaccgatgacgatgatatagaatcggagaccatcgcccagtatgcgcttcagatatggagccaagagcatatcggtcagcgtaagcatcagcagggtgacgagggctacagcgaaatcggctgccccttcttctatccccgtcacaatgctgtaaggcagaaagaggaaaacgaagacgtagtaattgatcggattggccaatgggcggaatataaggtactgtgctatggctttgcgcggtatcggcagctgccggtagtagttttcatttatatagttgagcggttgcaggaaaaggcggatcaccagaccggcaagcatcaggaaaggaatgagtccggtcattatttgcataggagcaagagccggaaagctttccttaattatgatcggaaagaaaagaccaaaaataaaaaggctcacacctacgaacaggaagtaaatggcccaaaatatcattatggcaacgctctgtgccgaaatggtggagcggatcgtgcgccgccattcgtgtcggaatagttctcgtggtacatggttctgtattaaatcttcgcttcaaaagaaaaccccgaaagtcagacaatgggctttcggggcttatttcgattttcagtacatgttgcttgttaatctccttccttttgggaggggattatccttggatggctgcaatgccggggagggttttgccctcgatggcttcgagcaaggctccgccacccgtggagacgtaggataccttatcggcaagaccgaatttgttcacgcaggcaacgctgtctcctcctccgaccagcgagaaggctccattggccgtagcttccacgatggcttcgccgacggctttcgagcctatggagaagttgtcaaattcgaatactcccgtgggaccgttccaaaggatcgttttggattcgagtattactttgcggaatttctcgatcgaccgggggcctatgtccatacccatccagtcgtcgggtatctccatattgctgcatacttgggtggctgcatcgttgtcgaacctgtcggctactttcgtatccacggagagtatcagattgacgcccttttcggctgctttcttcacgatgtcgcgagccaaatccagcttgtcgtcttccacgatggagaggcctatccgaccgcctgccgctttggtgaaagtataggtcattccgccggtcaggatcaggttatccactttgttgagtaggttctcgatgatttctatcttggtcgataccttggagcctcccatgatggcggtgaacggccgcttgatgtcgtgcagcactctttctacggcttttacttctttctccatcagatagccgaacattttgtggtctcggtcgaagtagtcagcgatcagtgctgtggaagcatgtgcccgatgcgctgtgccgaaagcatcgttcacgtagcagtcggccatggaagccagcttttgcgtaaactctttctgagcagccttgacggctttcttcgctgcggctttttcttcgtccgaagcatcgtcggagagtccgcgcggcttaccttcctcctcggcatagaagcggagattttcgagcagcagcacttggccggctttgagcttggccgctttgtccatggcatcggctccgatgcagtcatcggcaaagaggacatccacgccgagcagttcggatacgtgcggcaggatatgccggagggagaactccggtgctacgcctttggggcgtcccagatgagagccgatgatggtcataccgccgtcggctatgatcttgcggagagtggggagggctgcgcggatgcgggtgtcgtcggtgatcttaaagttgtcatcgaggggaacgttgaaatcgacgcgcacgaaggctttcttgccggcgaaattgaattgttctatcgtcattgtattgaatgtttttgcccctgacgggagaggttcgtttattgtgcggacaaacatacgaagtttatatagaagagtagttgctttgcccctttaatcggccctcggaatcccatcgtttcggtatcgatcccggatggaaacggcgttattggttcctgaagaatttatatatctttgctcggtctcgagggtcacccgattccgtcttacgagacgggttttttgtagttgtcggggacgattggacgagacttgcaacagagaaaacagaaccaacttaattattcaggtaatgagcaaattagatttgacaaagtatggcattctcaatgccactgagattatccacaacccatcttacgagttcctttttgaagaagagaccaaagccggtctcgaaggctttgagaaaggacagcttaccgaactgggagcagtcaatgtgatgaccggtgtctatacgggtcgttcgcccaaggataagttcttcgtcatggacgatacaaccaaaaacaccatctggtggacgtcggacgaatacaagaacgacaacaaaccggtgactccggaggcgtggaagagtatcaaaaagctggccgtggagcagctctccggcaagcgtcttttcgtcgtggacacgttctgcggcgccaacgaaagctctcggttgaaaatccgctttatcatggaggtggcctggcaggcccacttcgtcaagaatatgtttatccgccccacggaagaggagctggccaactacggcgagcccgacttcgtggtgatgactgcttccaaagcgaaggtggaaaactacaaagagctgggactgaactccgagacggccgtcgtattcaacctgaccgagaaggtgcaagtgatcctgaacacatggtacggcggtgagatgaagaaaggtatgttctcctacatgaactacctgctccctctgcgcggtatggcttcgatgcactgctccgccaatacgagcatggacgagaaggagacggctatcttcttcggtctgtccggtacgggcaagaccacgctcagtacggatccgaagcgcaagctgatcggcgatgacgagcacggctgggacaaggacggtatcttcaacttcgaaggcggatgctacgccaaggtgatcaacctgagccgcgagaacgaaccggacatctacaatgccattcgtcgcaatgcgctgctggagaacgtgaccgtggatgctgccggtaagatcgacttcggtgacaaatccgtgacggagaatactcgcgtctcttatccgatctaccacatcgagaacatcgtgaagcccgtgtccaaagccggccatgccaagaaggtgatcttcctctcggccgatgctttcggcgtattgcctcccgtttccatcctgactccggagcagaccaagtattacttcctctcgggctttaccgccaagctggccggtaccgagcgtggcatcacggagcctacgcctacgttctccgcttgcttcggagcggctttcctctcgcttcatcctacgaagtatgccgaggagctggtgaagaaaatggagatggtgggagctacggcttacctcgtcaatacgggttggaacggtacgggcaagcgcatctctatcaaggatacgcgtggtatcatcgatgccatcctcgacggctccatcgacaaggctccgaccaaggctattcctttcttcgacttcaaggtgccgacggctctgcccggtgtggatccgaatatcctcgatccgcgcgacacctatgccgatgccgccgagtggacgacgaaagcgaaggatctggccgaacgtttcatcaaaaacttcgtcaagttcacgggcaatgatgccggcaaggctctcgtagcagcagggccgaagctctaagagcggaaaaaaacactcgcggctttctgagagggaagccgaaagagagagaaaaaaagagggggagctgtgtcgcggatgacacagcccc

SEQ ID NO: 996 - DNA (genomic), 1213 bp, PORYPHYROMONAS GINGIVALIS; double-stranded, circular
  misc_feature 1...1213
  hypothetical: NO
  anti-sense: UNKNOWN
ccatcgtattgaggatcttacatcgacgcatcactccggctattcgagagaaagctcgttcgcgtgctgccaccatctttgaagattgaggcagataagcgactcattggtggcaagaatactcatgcttatctgcgggttcttcgtctttcatctttgatcttgtcatatcaggcctctgtgtatcctctctttgcgtacctctgccaacaaaaagactattagccttttagtgggaaaaggtgtatttttgtgcggcttaatgaaaagaagtttaatcaatccttagtaataacaagaagaaatggaaattgcaaagattattggcagggagatcctcgattccagaggcaatccgacggttgaggtagatgtacacctggcctgtggcataataggacgcgcggctgtacccagcggagcttccaccggtgagaatgaggctatcgagcttcgcgatcaggataaggctcgctactgtggcaaaggtgtcctcaaggctgtgaagaacgtaaatgaagtgatagatcccgcactctgcggaatgtctgtattggaacaaacagctattgaccgcaagctcatcgaattggatggcaccaaaacgaaaagcaacctcggagcaaatgccatgctgggcgtatcactggccgtagccaaagcagctgcagcttatttggatattcctctctaccgatatatcggcggttcgaacacctatgtcctgcctgttcctatgatgaatatcatcaacggcggttctcactcggacgctcctatcgcattccaggagttcatgatccgccctgtgggagcatgctgcttccgtgagggcttgcgcatgggtgccgaagttttccatgcactcaaaaaggtgcttcacgatcgtggtctgagtactgcagtcggggatgaaggaggttttgctcctgccctgaatggtacggaagatgctatcgaatcaatcctcaaggctgtggaagctgccggatacgtgcccggtaaggatattaccatcgcaatggactgcgcctcttccgagttcttcaaggatggtatttacgactacactaagttcgaaggcgaaaagggcaagaaacgctctatcgatgagcaggtggcttatctgaccgaactggttggcaagtatcccatcgattctatcgaagacggtatgagcgaaaatgactgggaaggatggaagaagctgacc

SEQ ID NO: 997 - DNA (genomic), 2060 bp, PORYPHYROMONAS GINGIVALIS; double-stranded, circular
  misc_feature 1...2060
  hypothetical: NO
  anti-sense: UNKNOWN
gcaggagtgaatgtataacgataaaatgtaaggaacgatgatgaaaagaataccgaatatgatttggataatcggggtactctcccttgtttttcggtctatgtgtcaaattgcagtgtgaagagaaaagctataaagcgccgaaattgcgtcggaaaacagcttcgagttgttgcttgacgaggataaaatcctgctcgcgtccaagttcacgactgatagaagtcacccctctatccgagaatccacaggggttgatcagtttgaagtaatcgagatccgtattgacattgagggcaaagccatgcatcgttatgtgccgactgcttttcacccctatcgcgcagattttgcgagtacgccccggtatatcgggatccagccatacgccggatgctccggccgaacgttcgcctttcagaccgaatatggcaatgagatcgatgatacactgctcaagcatttcgatatagctgcgtaagccgataccgtattgttcgagatcgaatatggggtatcccgtaatttgtcccggcccgtggtaggtgatatcccctcctcgttctatatgaaatagtcggatgtcgcgacttttcagctcggactcggacagcaacagattttcttcatgaccgtgtttgcccaaggttagaaccggttcatgctcacagaagagcagcgtattttgcggtttcctgttttccaatttgtctgctacagcatcatggaagagcttgcgttgcagggtcagtgccgattcgtaaccgatgcgtccgcagtcctgataatggtattccgaacgggaaacatgcggttcgaagtcttttattcttatccccttttcgtcgattatagcttccaggccatcatatcccgaatggatatgtggaggaagaatttccaaatgttcctgatgcaggggtgcatggtgggagaggtgaatcaggacactttccggattaccgatttgtcctattgtgtcaatagcctgctctatggtctggtgcgaaggatgttcctttcggtagcgaagcccgttgataaaaagaagtcgacagcttttcaggcactcgatttcttctgctgctatatccttcatatcggtaaggaaagccatctctcctattttatatccgagtatcggcaacctgccatgcattattcgaagaggctctaccgtcaggtctgccacttgaaacggcatatcgggttttacttcgcatagtttcagtagaggagtgcccggataaggatttttgcggaatacatagtgcagcctgtcgcgtatggagtccaatacattctgttcggcatagacagcaagttcgcgatgccaacagatggtgcgcagatcgtcgagtccaccgacgtggtcaaaatgttcgtgagtcagcaaaacggcatcgagcgaatcgatgccggcaaacagagcttgttggcgaaagtccgggctgcagtcgatgaggattcgtttccctgcatccgtgattataagaagagaagtacgggtgcgcttgtcatgcctgtcttcgctacgacataccctacaatgacagccgacttcggggacgccggtgctggtgcctgagcctaataatatgcaacgcatgggggcaaaaggcttgctacttgatattataaaatgtatttgacctccggatggagagtgattccgaatttctgtcggacattgcctatgatctcttctgccaaagctcccacctgagtgcccgtagctccgccatagttcaccaagaccaaagcctgatgctcatagacacctactgcaccggagcgatgccctttgtatccgcattgctcgatcagccatccggccggaactttcacgctgccatccggttgaggatagcttggtatggagggatattcggtttgcagggtattgaatttctcggcggataccaccggatttacgaagaagctgcccgcattgcctattgtggccggatcgggcaacttggaattgcggatgcgtatgaccgtatctcgaatcgattgtagggtaggggtgattcgttcttcttccaaaaccttggccg

SEQ ID NO: 998 - DNA (genomic), 1847 bp, PORYPHYROMONAS GINGIVALIS; double-stranded, circular
  misc_feature 1...1847
  hypothetical: NO
  anti-sense: UNKNOWN
tgcgtcgtgctcggttgaagggactggccaaacagtatgccgatcagatccaaacgttggacaagctcattcgggaattccccgatagccgccatctgacagctgctctctatgaaaaggggtgtggtgcagtgcttagcggtaagcataacgtggcagaagaagctttcaatgcagttgtcaaaagaagccccgacagccgtgaagcccgacagtcgtccttgcagttgggtctgctctattataatacgggtcgaacgaaagaggctattcgcacataccaacggatcattgaccgctaccctcgtagcgaagagacgactgtagccctctcggatctccgttctatctatctggaagaggatcggatagatgagtattctacctatgtgcgtggtctgaaagataaggtgtccattgccccatccgagacggaacagctcggtttcctttcggccgagcgcaagtatcgccgtcgccagcccgatgctcgtcgagatttggaggcttatctggagcgctatccacagggaagcgatcgtcacaaagcagaattgtatttggccgatctcgattatcaggccggcaatgctgatgcggcttacaatcgttattcacggttggtgaacagccccggtttgcccgaagactataagatcgatgctcgcctgcgtctcggtcgtatgcaatacgaacgcaaagagtacaaggctgcgctgcaatcattccaatccgtactcgatacggatggtgccgaagctgtccgcgatcaggcggtgcagggagtaaccgagtctgcctatgccgataaggattaccggagggtgatcgacgtaattgccggattgaagaatcaggcagctctgcctcatactcttcgtctctatcgtgccaaaagttatcaggctctgaagatgaatcgggaagcgattgccgactatgaactccttgccgaggatttctcaacggccacaggtgccgaagccgtcgtgatgcaggcacagctggaaatggaagccaagcgtttgtccaaggcgaagtctatcctcgaaaaatttattgccaagagtactcctcagcagtattggttggcacgaggtttcatcctcttgtccgatatttataagaaagaaggggatacgtttacggcaaggcagtatttggaaagcttggaaaagaactatcctaatcatgaggatgacattcacgaacagatagcccaacggcttgaataatcttctgtacgattcatcactctgagttggaaataatgaacagcatcatgaaatatcaattatatacggccgtcataatggctctctctgtatcatccgtttgcggtcaaaccccacgaaatacagaaaccaaacgccccgacacgctgcgcagggagcttactatcgttaatgaccagactgtggagatggagcatgcggatccgcttccggctgcatacaaggccatcgaacctcgattaaaacctttccgtccggaatataacaagcgtacattcggatttgtccctgaagtttcctcttcaggcaggaacaatcttccgaatatcctgccgacggaaggtcatatgaagcaccgggggtacctgaatatcggtatcggccatacgctaaaccagcgaatggatgccggctatcgtctgatagatgcagagcaggagagactgaatcttttcctctcctatcgtgggatgaaattggctttcaataccggtgacttcgacggcgacagaaaggatagacgaaatgatggcaggaatggactacgagcagcgcaggccttcctttgtgcttgctaccggcttggattattcgaaccattatttcaatact

SEQ ID NO: 999 - DNA (genomic), 4851 bp, PORYPHYROMONAS GINGIVALIS; double-stranded, circular
  misc_feature 1...4851
  hypothetical: NO
  anti-sense: UNKNOWN
aggttcttcgaatgcgtctttcatgctgaagttggtgagggactatttctctctaccgatcgatgacgaagaattggcggcaatagcactgacgatcggtgccgattgtccttttttcgtaggaaatcggccggtattagccaccgaccttggccaagtctttactccgctacccaatttttctctgtccggtctccatatcgctatagtaaaaccacccatccatatcaacacagcagctgcatacaaaggtctcaagcatgtgggcaaacgagagacaatgccggatgagattgtttacatgcccgtagaagaatggagagggaaattggtgaacgatttcgaagaaagccttttccctgaacatcctcgacttgccgaactaaaagaaatgctctatcggtcgggggctttgtacgctgcaatgtccggttccggatctgcactattcggtcttttccgggaaaagcctcagctcgataaggctgctatcaccgactgcttccgatggcaaagcatcatcccctgacagattggttacctacctccaaaaaagaaatggaggccaaaggatgggacgaagcggatgtcattctctttagcggagatgcttatgtggatcacccgtccttcggagctgccgtcgtaggaagaattttagaagccgaagggcttcgtgtggctatcgttccccaaccgaactggcgcgacgatcttcgggacttccgcaaattgggacgtcctcgcttgtttttcggagtttcggcaggagcgatggattcgatggtgaataaatacaccgccaatcgccgtctccgcagcgaagacgcttacacaccggacagacgttcggatatgcgtcccgactacccaaccatcgtttacacccgcatactgaaagagctgtttccggatgtaccggtcattgtcggggggatcgaagcttctctccgccggctgacgcattacgactattggcaggacaaattgctccccggtatactctatcaatcaggtgccgacctcctgatctacggcatgggagaacttcctttgcacgagatagcacagcgattgatagccggcgaaccgttcgatagtttgaagagcattcggcagatagcctatcttgttccaaaaggaaagacacctgtgccctgcgaaaacgatcggcatctcttctcccatgaagaatgtttgtcggacaaacgcaagcaggcacagaacttccgagagatagagatacagagcaatcgctacgaggcagaccgcatacttcaggccgtcggagattctaccatcgtggtcaatcccccttttccacccatgagtacggcacaaatagatcagtcattcgacttaccgtacacgcgcctgcctcatccgcgttataaggggaagattatttcagcctatgagatgatcaagcactcggtcaatgttcatcgcggctgtttcggtggttgtgccttctgtaccatttcggcccatcaagggaaatttatagcctcacgcagcgaagcgtccgtactccgcgaagtgaaagagatcactgaaatggaggatttcaaggggtacctgagcgatgtcggaggcccttcggccaatatgtacaaaatgcagggctacgacctctcgatctgcaaacgctgcaaaaagccgagttgcattcatccgaatgtgtgccccaatctgaatgccgatcatcgtcctctgctggatttattgagaaggatcgacaagaatcccaagatcaagaagagctttatcggcagtggtgtaagaatggatctcctccttcataattataaagacaaggtactgaagaaagctgcggacgaatatacggaggatcttatcgtaaagcatgtatcaggacgtctgaaagtagctcccgaacatagctcggatcgcgtactcaatctgatgcgcaagcctcctttccggcagttcgccgaattcaccaaacgtttccaacgtatcaacgaagcacatgggctgcgtcagcaactcatcccttatttcatatccagccacccgggctgtaccgaagaggatatggccgaactggcgatactgacaaaaaagctcgacttcaaactggaacagatacaggactttactcctacacctatgaccttagcgacggaaatgtactacaccggctaccatccttatacgcttcagcctgtatatacagccatcaagaaagaagaaaagatgcgccagcacatgtttttcttctggtacaaacgggaagaagccgacaagatccgtcgcgagctacaccgaatcggacgaccggatctcattgccaagctgttcgatcgcactacttcctctcgcaacgatcgccatactcctccgtccacgcaacctcgcaaaagcaaaagcaaaagccgccattcttagcgacaaggattacacttaaagtcggaaaatcttgacgaaaggcgaaggccttttgagtggaaaaaggtagagacgagacgaaagcaatcctcaaatttccaatcagagaaaagcagcttttctcgggctcacaacatgagaaagaggccgcgccacctgttggcgcggcctctttgcttggattggtaatcgatcgaagcgcagagactatgcttcgtctttggtctgctcttcgtattctttcagcagacgctcctgtacatcggcaggaaccaattcataggaagcaaacttcatcgtgaaggatgcacgtccacctgtaatagagctgagcgaagtggaatagttggaaagctctttcagaggcactttcgccaaaagctgctcataacccttgcggctgttcatacccatgatgatggcacgacgtccctgcatatcgctcatgacatcgcccaaataatcggcaggaaccgatacttccacatcatagacaggctccagaatcttcgggccggcttctttgaaagccgtgctgaaagcattccgaccggccagcatgaacgatacttcattgctgtccacagggtgcatcttaccatcgtaaaccactacgcgcacatcgcgagcatacgaaccggtcagcggaccctgctccatgcgcgacatgatgcctttcagtatggcaggcatgaaacgcatatcgatggcaccacccactacgctattaacgaagacgagcttaccgccccattccaattccactacctgcgtgtcgcgcggagtgatacgaaactcctggccgccgaatttgaacgattcgggcagtggtttgtcgtcactgtacggctccacgatcaggtgcacctctccgaactggccggcaccacccgactgttttttgtgacgatagtccgcacgagcagcctttgtaatggtctcacgataagggatacgaggctctatatattctatctcgatcttttcgttatgttccaatcgccatttaagcgtacgcaggtggaattccccttgtccgctgacaatggtctgacgcagctctttgctctgttccacgatccatgtcggatcctcttcgcgcatctcattcagagctgcattcatcttttccgtatcggattcgttggcagccctgatggcacgacggtacttgggctcggggaatttgaccaagtcgaaacgatgctccacgcccttttcgttcagcgtattgccacggcgtacctctttgagcttcacagtagctcctatatcgccggcacacatctggtccaccttgatgcgttgctgtccggccggcacgaatatctgactgatgcgctccttggagcctcggtcagcattgagcagatctactccctcggtgagggtaccgctcattactttgaaatatgatacttcaccaatatgcggttctatcgtagtcttgaagaaatggatgcaaaggggagccgaagcatcgggtttcacttcctctccgctcacagccacaggtgccggcagtttgttcacgccgggaaccacgttgccgaggaactccagtgtacggcgcacacacatatccttctccgcactgacacagaacacggggtacataccctgcgagatcagaccggcacggataccatcgcgcatctcctcttcagagagacttccctgatcgaagaatttttccatcaggctctcatcgttttcggccgcagcctccaccaaagcctgatgcatttctttcgctttgtcttgctcctcggccggaatctccagtacctcgggcacacctccttcaggtttccagcgatacattttcatcttcagcacatcgaccacggcattgaaccctgctcccgcatttacgggatactgtacgggcactatcttggagccatatcgctcccgaagctgtgatacagcagagtcgaagtcggccttgtcctgatccaactggttgatgatgaagatggcaggcttgtgcaactgctccacatagcggaattgattgataagccctacttccacgccatactgcgcattcactactacgagggcacagtccgtgacgttcagagccgagacggtaccgccgataaagtcgtccgctcccgggcagtcgatgaaattcagctttttatcctgccactctacagagaaaaccgtagagaatacagagtatccatactccttctctacggggaaatagtcgcagaccgtattgcctgcatctatgcttcctctacgttttatcactccaccctcgaagagcatcgcctctgcaagggtggtttttccggcgccggagctacccaaaatggagatgtttttcacctcatttgtcttgtacactttcatggtgaagtcgttggtattagtgnttttaacaatccggattagaatcgccgcttcgagaggctgtacaaacct

SEQ ID NO: 1000 - DNA (genomic), 1173 bp, PORYPHYROMONAS GINGIVALIS; double-stranded, circular
  misc_feature 1...1173
  hypothetical: NO
  anti-sense: UNKNOWN
ctgagaattttatttccttctcttttcgtgacaaatctgtatgtatcaacttatttcggttgatataattgcgcaccaaagatagtgccaatttgggagttgcaaaaataactgtagagccaagacttatggcaaggcattagtcggggattagctgtttcaaaagtgtgcattcaaaggataagcatttatataagtaaacataatacagattatcattgtttgtgtcgattgcattacacatcttctaattatgttcaattacgagtgagccgatcaactcttttacatcactnttccatgccttcgaagataatcctctatgccatcgactatataagaagctgcagcaggatctacgaagttgtaacagcccacctgaacagccgtggctccggccaataagaattcaatggcatcagctgcagatgcgatcccccccataccgattataggcacttgtaccaccttggcggtttgccataccatacgtagagcaatgggcttgatacatggcccggaaaggcctcctgtagtggtcgaaaggatgggacggcgtttttccgcgtcgatagccatgccaagaaacgtattgaccattgaaatagcatcagctccttcggattctacggcgcgagctatctctgtgatgtctgtcacgttgggagaaagttttacgatcaatgtcttgtcataagctcggcgcacagctttaacgacggatgccgccccctcacaggtaaccccataagccatccctccctgcttgacattaggacaagaaatattcaattctatagctctgatatgctccagttcatttattattcgggaggtctctgcgtaatcgtccaaagtggagccgcttacattgactatcatctccgtccgataatccttgataaccggatatatatgctctacaaaatagtgaacacccttattttgcaagcccacggcattcagcatccccgatggagtttcggccatgcgtggatatgcattcccttcccgatgatgaagcgtagttcctttgacaactatggcacctaagcggtctatatcgataaaatctttgtattcggtaccatagccatacgtaccgctggcagtcattacgggatttttaattgttaatcccctacctatttctacttctgttcgaaccattgt

SEQ ID NO: 1001 - DNA (genomic), 2028 bp, PORYPHYROMONAS GINGIVALIS; double-stranded, circular
  misc_feature 1...2028
  hypothetical: NO
  anti-sense: UNKNOWN
cggtacccgcatggaagcttcagaatcagatggctaataatccggagacagtgctggcttttgtcaagtcgatagctacgccctatgctccacaggcacagaaagacgctgccgaacttcaggcttatgcccgctccaaaggtttcgaaggagaccttacggctgctgactggaactactatgccgataagctccgcaaggaaaagttcggtctggatgagaacgaagtgaagcagtactttgtgacggacagcgtcctcaagaatggagtattctatgctgccaacaagctctatggcctcacattcaaggagcgtaccgatctgcccgtctatgccgaagatgtacgcgtattcgatgttatcgaccaagatggcaagcagctcgcactcttctacaccgacctctatcgccgtccgaccaagagcggaggtgcatggatgagcaactgggtagaccaaagctacctgctgaaccaaaagccggtgatctacaatgtttgcaactatgccaaaggcgttgatggtcagccctctctcatcaactacgatgaggtgaccactctcttccacgaattcggtcatgccctccacggtatgtttgccgcccagcagtatcctttgctctccggtacgaatgtggcgcgtgacttcgtcgagatgccgtctcagctcaacgaacattgggctatggatccggaagtgtttgccaactacgctaagcactggaagacacaggagcctatgccggccgaattggtcaagaagattcaggatgcgagcgacttcaatcaggcttattctatgggagaaaatcttgcagccgtaagcctcgatcaggcatggcatacgctcacggtcgaagaggcggaggccattaccgacgtggccaagttcgaagaagaagccctgcgcaaagtcggtctctacaatccgcagatacctcctcgctatcgctcctcttatttccgccatatctggagcaatggttatgcatccggttactacgcttatctgtggacagaagtgctggatcacaacgtttatcaatggatggtgcaaaacggtggtatgactccgcaaaacggacaacgccttcgggatatgattctttcgcgtggcaatacacaggatttcaacgtgatcttcaccgcgttcaccggtctgcaaaagcctgacatcagggatttgctccgcgctcgcggtctcatgtaatacagcaatagacgaggctgtgctttcaggttccaagatcctgcaagagcacagcctctttgttattcaccctataccaaaaacgaaacagctacgatgaaaaaaggagatctactcatccttctgatcattatcctgatgttggggcttatgctttccccttggacatcggaaacattcaactccctcagtcgccattatccttattatatcggtttcctgaagtttgccatcttggctaccatcggtgaagtactggccggacggatcaaagcccaacgatacacctgccccacctatctatgggtgcgtattgtgatatggggcattgtcggtatactcatcgtcttcaacttcgggttgtacgaagccggtatacgaggtatcatcgcaagaggactgctccccgacatcgacagttcggtctatacggctttccttatctcttccgccatgaatctgacattcggcccggccttcatggccgcccaccgcatcagcgatacatatctggagaataaagctacaggacggggaggaagcatccggctcgccgttgaacgagtggattggaatcgctttatgactttcgtcgttggcaagaccattcccttcttctggataccggcacatacggtcacctttttacttccacccgagtaccgcgtctttgtggctgcactcctgtccatcgctctgggactgatcttggccttggcttcctcccgacatgcaaaggcgtaaaacatcagggaccgacacaaggatttgataccaaaatgatgaaaatgccatgaaggaactgaaatgcccc

SEQ ID NO: 1002 - DNA (genomic), 9377 bp, PORYPHYROMONAS GINGIVALIS; double-stranded, circular
  misc_feature 1...9377
  hypothetical: NO
  anti-sense: UNKNOWN
ccgtacccgaattttattgattaaatgtatctgtttttgtaacaaatgtagtcgttttcttggacatccagtctatagttagcgtccaatctcttgagtgcagagtcccaatctgtacaatgtccgaaggtaagctttgcattcactcagattttccaatggttgtcctttccttttatccatccattggccttccacatagggtggaactcatggacaaagaaacagaagaacagagcttgaaacacagaaaaaagaaccgaagctgtgtcaaaactggattttggttcagtcctttttctttgtgatttgcctggagtaaggcgactaaaaagaaaaacctctcaatttcaaaatgaaatcgagaggttcgcattatacaagttttgtgtcgtggtgccaccaggaatcgaaccggggacacaaggattttcagtcctttgctctaccaactgagctatggcaccttgtctcttgacgggtgcaaagatgtgtgttttatttgataccaccaaattttgtcaccgtttttttctttcgcagatccggtatcgagtacaacgttgcgataaatttaggattgagacgtcgagaggcgttctgaagttccggttccttccgggtatatgattcggatcggcttcggtttgctcggtctgtgcagagataagagagccggttcctgtattgcagaataggcgcaatccgatattaaccgacatttcctgccttttgagaagaaaacttctgccacgatcatgttacgttttcacaaaagtggcgatgaaaggtgacaaaatagcatgccgaacagcattcgaatgacttttggtctaatctctgccccatcggcacggtggcactgtatttgtagcctcttacaagcaaggatttacagcccgtaaaaacggattcggacgatgcccaaaggagtattccggcggacccttcatactttatactataaacccttccgactttatacttaaaaccctccaccctttatactataaacccataccactttatactataaacccataccactttatactataaacccataccactttatactataaagcctctatactttatagtataaagcctgcgagctttatagtcggaagtattaaagggatgattgtcgtgctacacttgtgcaagaaaaaggatcagaacggatagcctactgcaatgtgccaagcgaaattggaagaaaggtttgggcgtgtgatagcccatttgtaacgccctgtctgctgaggatcgtaggctttcagtccggcatccagccgcacaaggaaataatcgaagtcgagacgaagccccagaccgtaggccaaagctatttccttgtagaagcgatcgaaacgaaagagaccgtcctcctgattctcatactcctttatcgtccagacattgccggcatcgacaaaagctgctgcgcgaaacttccagaacagctttgtcctgtattcgacattcagatccagacgaatatcacccatctgatcgaagaaggtcttgtccggagtcatcttcatactccccgggccgagggtacggacactccagccgcgaacgctgttcgatcctccggcaaagtaacgtaactcaaagggtatatggcgagcattgccataagggaaagccagtccgaaacccagatgcagtgccaaagtattgtccttttcgagaagaacggttttagccagatcgagatcgagcttgacgaactgagcatagtgcagaccgaacattttatacaacccgtgttcgtctttcggagaatcggtcagataagaaatggcttgcagcaggttgccggctgtctggatactgaaccgtgccgtaaaaggattggatacggtacgctccatggacgaagccgtggtatagttcagtatatatgccgagccgaggataaactgctccgtgtagttatacagtgcagtcgtaggcggaagggattgggcgaagtcgggatcgatgtacgggagatggagataatcgacatccagcaggcggatcgtatgacgcagacgattgtgcaggtaggtctgccatgaataattgagttgagcggagagaatcacccgatcaaactccggacgtgtctggtaattatacccgatcttccattccgtggatgcccgtagccgccggcgcgtttcgtcagaaatgaatgggaagaggagacgagggaaacggagcgagctttccaccccatattccatgaagctgtgcgaacccttgcgaatggcttcgtaagcacccttgagtttgatattgaacatctccgccccacgaaacaaattgcgatcggtgaaaccgagagacaaagccgccccgaagtctccagcggaattggtgccgaggacttcggcttcgaacgatttgctcttggccggaacggtaagaatatagcagtccacaaggcgagagctatccgccagagcaatctcatccttaccattgtgctccacaaatcggatattcacgttccgaacgatagggagcgcattcagcttgatataagagcgttccacatcatcctcgcagaaaaaagctcccggtgtaacggacaccgaccgcgtgagagccgatgcccggatataacgtcccctactcccatagtaaacagtgtaatcgccacgcgaaatcgaatcgatacgtggcagctcctgaactctgaagtccgattcgagaggatcataatcggcatgaaagaataccctgccgatccgatatggataacgcccgatgccattgaccactaatttcagatcggcagatttcgtacccgatcctcctgaaacggtagtatctgcttcataataaacatcctcggcggagaacttccagaagccgttgttgcgcatatgacgagctatcgcctttctctcttcatcgagtacgatgggcgacaagggagaaccctcgctgatcccgaccttgtatgccgaaggaagcgaattgccaagcgcaacgggaggaaggagtggattcttcacatccaaagccatattgcgtatataataacggcttccgggctgaatcagataagtaatgcgagctttcttgtacaagccggtgtctaccacggcacgagcagtagcatcgagaaagccatcgccggccatcgcctttgccagacggttggcagtacgatcggtgaggacagaatcgatgaggacaggcggttcgcccattttccggagcgaacggttccaccagctgttgctgttcggattcgagctgctatagacgcgcagtagccagcgagtcatcccgaacagtctgtaattgggttgctggagggtatagtcccgaatatcttccggcagagcgatactgcccgtttcgcttgcgatcgttaccctgtctaatagtctgctaccgtccggcacataacgggtgaccgagcaggaggaagcaagcatgaggagcaagcagccggcaatgccgattagataccgaacggaatgcgaggacataggaaaacggatatacggggagagagactatcgttcgttccagatacgccaactgcacaacgcctgtatgagcagcatctccaatccgttctgcacagaagcaccctgtgcttgagcgcgatgcatgaagatcgtttcctgcggattatagatcagatcataacagagatgctctgcacctataccctcgaacggaatagacggacattggtctatatgtggatacatacccaccggagtggcattgacgatcagcttgtgccgttcgataatctccggcgtcagatccgaatatgcatacacaccgggagccgaaggcgtgcgactgacctgccgatgtactattcccatcttcttcagagcgcgcatcacagccagagctgccccacccgatcccaagacgagagcttgcgtatgccacggctttcggatcagctccaggctatcggcaaagcctttcacatcggtattataaccgacgagatggggacgacgaaagcgcgcacgttctacccgaatcgtattgacggctccggtcaattccgcttcctcgtctatccgatccagatagcgcatcacctccactttgtacggcgatgtcacgttgaacccctgaagagagggatggagcgaaagcagactcttcagttgggagagcgactccagagggaaaagttcgtagacggcattgattccctccgtcttgaatttggcgttgaagaattcggcagacagcgaatgagccagtggatagccgatcagaccgtactttttcatttcagtcccatataaacggttgccacctccaacgaaaggctacgataatacgcttcccgaaatccgacagagagcatcaggtccgccagttcttcccgttgaggcatggctgctatcgattcgggaagataggtataggcttccgcatcctgtgacaggaaacgaccgacaaccggtatcacatgcgaagcatagaagttgtagccctgcttccaggggaaactcaccggacgggaaagctccagtatcatcagaggagcaccctcattgagcacacgatacatttcctccagaccgagcttgatattctgaaagttgcgcaagccgaaagccactgtaactgcatcgaaactatgatctgcgaaaggaagatcgagacaatctttctgcatgaacgtaatccgattgtccaaattctccgaacgtactttctgctcccctatcctcatcatttccaacgaaagatcgacacccgtcacctgcttgactgaagggatatgcctgcatatttcgatggctaaatcacccgttccggtagccacatccagcactgtatgtggagcgaaaggctcgatcatacggatagccttctgccgccatacacgatccattccccatgaaaagaggtgattgagacgatcgtaatgtccggcgatatgattgaacatggcctctacctgttcattcttggggcattcggtgtcatagggggttattctttcaggactttgcatggcacatgattgttcgacagtcagccgactgctaacgcagatactccgttatgttcttttctattctttctgccagattgctcaggtctgccttttcgaagggcttacctaccactcgctcgtacaattctatgtaccgctccgacacactgtcgcagtatgcttccgtcattttcggtatttgctggccgggcttgccctggaaaccgttctcgatcagccactgacgaacaaactccttggataactgcttctgggcttcgccccgttcgaatcgctcctgatagccctcggcatagaagtagcgagaagagtccggcgtatgtatctcgtcgatcaggtagatcttaccgtccttcttgccgaattcgtatttggtatccaccaaaataagccccttttcagcagccatttgagtaccgcgctcgaaaagtgcgtaagtatagcgttctatctgctcgtagtcctctttcgacaccagtccctgagcaatgatttcctgacgagagatattctcatcgtgaccctcatcggccttggtcgtaggggtgataatgggatgttcgaaacgctgattttcgcgcatgccctcgggaagaggcagaccgcaaagcactcgctcgccggcagcataggcacgccatgcacttcctgtgatgtagccgcggatgaccatctcgaccttgaacggttcgcaacggtgtccgatagtaaccatcgggtcgggcgtagctatcttccagttcggaactatatcgcgagtggcatcgaggtagtgtgccgctatctgattgagtacctgacccttgtaagggataccggccggaaggactacgtcgaaagccgatatgcgatccgtggctatcatgaccagaagatcattctccaacgtgtatacgtcgcgcaccttgccgtgatatacggctttctgtcccggcagtctgaagtcggtacgagctaatgtttctttcatcgtgaattgtatgctaagtgattcgtaataatatcgatatcgcctgattctatatggtttgcgcaacgacagctgcggcttcggcctcctttttccgttcggcatcgtaccggtcgtaggcatccaccacacgctgtacgagcggatggcgcactatatcagcgcgttggaatgcaatatagcctatccctctcgttccttggaggatattcagagcctgacgcagaccggagtgcacacctctgggaagatcggtctgcgtaatgtcgccggtgacgatcatcttggcattggcaccaaggcgggtcaggaacattttcatctgcaactcggtcgtattctgagcttcgtccagaatgaccacggcatcgttgagcgtacgtcctctcatataggccaatggtgctatctggatgatgttgttttcgatgtactcttttagcttcacggcagggatcatctcctccagcgcatcatacagaggctgcaagtagggatcgagcttatctttcatctcaccgggcagaaatcccagcttctcgccggcttccacggcaggacgtgagagaatgatacggcgcacctgcttgcttttcaaggcacggacagccagactgatggctacgaaggtcttgcccgttccggcagggccgatggcaaaaacgaggtcattggcctcgaaagcctccacaagtttctgctgattatcacctctggcaatgatgctcttgcctcccgttccatgcaggataagatgtttagggacatcgtcagcgggcagcttggcaccctgtgcaatgcgcaggatcacatcttcgggcaggaggttgtactcacggcaatacgccaccatcggctccagaacttccaggaaacgatccgtctcgcgcgaatcgcccataatcttgagcacattatggtgtgccaccaggcgcaacttcgggaagagagtgcgcaagagcatgagattgctgttatttacaccgaggaaagcctgtacatcgacatcttccaatacgtaaattctctctgtaatcagcatatgtatccaataacaacggtgcaaatgtagtctttttcattccatttaggttcgcaaaaaaaacatagaatgagaccgttgcacaataaccctcccccccctcatatcgatcaagacagatacatgcattgatttgacgaagaaaggagagcttcatgcgatctctctgcaaacctcaagtaatctgaaaaacacttaagaatcagctctgcggcaaaagacttcaatgaaagtcctataaaatagttgcaaacagctgatagttagcgtattgatgggagcagagtcagctgacaatcgcgtcctgcatcgtgcaggaagcaagaatcagctgacaatcgcgtcctgcatcgtgcaggaagcaaaaatcagttgacaatcgcgtcctgcatcgtgcaggaagcaagaatcagttgacaatcgcgtcctgcatcgtgcagggagcaagaatcagttgacaatcgcgtcctgcatcgtgcaggaagcaagaatcagctgacaatcgcgtcctgcatcgtgcaggaagcaagaatcagccgacaatcattccttatttctcgcctatcggcacaagcattgatttgacgaggaaaggagtacttctctaatggaaacttgatgaaatttctgtttgcttgctgtgtccatataccgaaggtttgacctttcccgaagacactaagaatcagctctgcagcaaaagagctcgatgaaactcccatgcaacagtctcaggatgcagttgcaaccttctgtatcaaaaactcaggtatatgcttgtaatcctaagcaacttcggctttatcgaggacgattgcttagttcgtaacggaggtgaccgcagcgcaccaaatcggcatggctgatatgccttgttccatgcggaagtgttttattgccaagagaaaccgtatggatgtaaatggaatctgtcggttgattctctgtattggtcgtaatgatcaactccccctgaggataatactgcggattgagccgaatcctaactcgggggaataccggcgaggtcagtgtataggtggggctgcccggacagtcagggtagaatcccagcatggaatagacaagccaagcactcatcgtaccggcatcgtcattaccgggcaagccgttaggagcattgcaaaaatgtttgtctatcaactcccgggtcaatttctgcgttcgccatgcttccttggggaaataggagaagaggtaaggataggcgatgtccggctcgttggtcggatcataatatccttcatcgaagacttttctgcaacctttccgaaaaaacctttgctcctcccatcagccgggcaagcccttgtatatcgtggggaacgaaaaagcatagttataagcactgnccttgtggaaaccgggattaggcttcgaagttttcaccctgtttgggatcgaaaggagtgaggaatgatccatccggcagcaatgggacacagcataccatacttccttatataatagtgtctgtagcccaacgagcgtttccgaatagagctgcgtcttctttatgcccaagtgcgtgggcaaaccgggacagattccagtcggccagatagtattccagcgcatgcgatacggaattgtcgtactgttcgcgaagcggtacgaagccgagggtgagatagtcgtcgttgtcaggacggatcggatgggtcgctcctgccgaagaagcattttttttcatggcttcataggccgttgccgtatcgaaagcacgaaggcccctttgccaagtgtcattgatgacgataagcgaggggtcgccctccatcgtcagggtctcctgtccgtacagctcccatctcggcagccacccgctctctcggtacatgtcgatcagtgtccgtaccatatccaactgcttctccggatagaggaggcagagcagcgggtgtacattgcggtacgtgtcccaaagagagaacacggtgtagcggtcgtgagccgtattacccgttttgccactgcccatcataggatattctccattggcatcttgtaggatattcggatgtatcagcaggtgatagagtgcggtatagaatatcgtcttttcatccggtgtgcctccttccacttccaccgtaccgagggcttcctcccaacgctctatagcgcgagagcgtatagcggagaaagccttggccggattccctccgacacttttgaacacctcttcttgctccgcttccagattatagagcgcattggcttcgctgacgaatgaaacggccgatcgtacatagatcttttccccctgatcgcagttgaacgagaatcggacaccgatgtcatcaccgctcatctcccgcttgtagccg

SEQ ID NO: 1003 - DNA (genomic), 9686 bp, PORYPHYROMONAS GINGIVALIS; double-stranded, circular
  misc_feature 1...9686
  hypothetical: NO
  anti-sense: UNKNOWN
aatcctctttggactcggcaccctgctcaacctgccggagcgcgagaaagtgatgctccgtctgctgcgcggcatagccgatcggtacgactacgtcctcatcgactgctccccctcgctgggccttatcacggtcaacgccctcgtggcggcgcattccgtcatcatccccgtgcagtgcgaatacttcgctctcgaagggatcagcaagctgctcaatacgatccgtatcatcaaaagcaagctcaatcccacactggagatagagggtttcctgctgaccatgtacgacagccgcctgcggctggccaatcagatatacgaagaggtcaagaagcacttccgcgagctggtcttcgatacggtcatccagcgcaacatcaaactaagcgaggcccccagccacggtattccggcactgctctacgatgccgatagccgcggagcggtcaatcatatgcagctggcggccgagctgatcaaaaagcacaaacagaaaggagcctgactctcatatgaagcatacgaagaaaacgctcggtcgtggcctggactccctcctcgatgcggaggtcatagggtcttcttccatcagcgaagtggccatcagcgatatataccccaatcccgatcaaccgcgccggactttcgaggaggagtccctgaaagaactggccgcttcgctccgttcgataggattggtacagcccatcacactactgaagaagtccgccggcgactatatgatcatctccggagaacgccgctggcgtgcggcccgaatggccggtatgaccaccctgccggcatacatcaagacggaagaggacgaacatgtgatggagatggcactgatcgaaaacatccagcgcgaagacctcaacgccatcgaaatctctctggcctaccagaagctcatagagacgtacgacctcacacaggaggaactcagcacccgagtgggcaagaagcgcaccacgatcagcaactacctgcgcctcctcaagctcccgggcgagatacagataggtctgacccagaagaaaatagatatggggcatgcccgcgccttgctcagtatccccgatcccgagcatcagcttgccctctatgccgagatcatcaggcagggactgagtgtacgtgccgtcgaaagtctggcggcgcactaccgcgaagaaggtgccgattcgcccgccaagcagaagaaaaccaagcagtccctgccggaagaataccgcctgctcacggggcagttgtcccgattcttccggacgaaagtcaagctcgactgcgacgccaagggcaaaggcaagctgaccattcccttcgcatcggaagaagagctggagcgaatcatggccctgctcgagcgtatccgctaatcctcacaccgtagccgtcatgtccggaagtcgttggagaattgtcgttttgttcctctgcctttgtctttctcaggcagcggcacagagcgtcgtccccgacagtatcgggcggccggcggcgagtgcggccgattcggcggccacgaagctccccgatacgctccgagtgcagacgctttccccgccggcctctacagcatcctcccgagacctccggacagccaaggcgtggaaacccaatcccacccgtgcactcctctactcggccctcctgccggggtcgggtcagatctacaatcgcaagtactggaagctgccgatcgtatggggcgcattcaccggatgcacttatgccatcctgtggaacaacaagacgtacaccgagtatcgcaaagcctatgccgacttcatgggcggcgatccgtcgcaaacggcctggcacaacttcctcccctacggagccgatcctgccgattatgtcaatagcgagcagctcaaagctcgtctcaagcgcggcacggagtactaccgtcgcaacagggatttgagtatcatcattaccctcggtgtctacttcctgacgatgttggatgcctatgtggatgccgaattgttcgatttcaacatctctcccgacctctcttttcatttcagtccgatggtgggcacagacgataagtccggctttttccgttatggagttagctgcggtttcactttttgacctctccttatgctccggatgaaatactgtctcctccctgccctcattgcctttctggcctttctgccggtccgatcgtcctatgccataggtcgttacactccggcagactctacccaagagcttcgcgatgcagcccgtcgcctcctgccctcttcttccttggacaaggatttggagagactcctccgcacttggcataaaggatattccaccaagacaaaacgtggcgagcgtccgtgcatcaattccgatacgggtccttatacatcggactccgtgtacatccggcgactttccgccctgccatcggctgtacccatacaattcaaccctgccgtcaagcagtgcatcaagctctacaccgaggaacgtcgtcgccttgtccgctatatgctctcgctcgccgacctgtatttccctcagatcgaagagacactcgaccgtcataacctcccgatcgagctgaagtacctgaccatcgtggagtcggctctcaaccctacggcagtatcgccggccggagcagccggtatctggcagttcatgctggctacgggcaagatatacggactcactataaacagcctcgtcgacgaacggctggatctgcagaaaagtacagaggctgcctgccgctacttcaaggacatgtacgacctctatcgcgactggctcctctgcatcgcggcttataactgcggactcggcaatgtgaacaaagccatccgaatgtccggtggcaagaccgacttctgggagatctatccctaccttcctcgcgaaacgcggaactacatcccgctcttcatcggtgcgtactatgccatgcactaccatatcgaacatgagatctgtgccggagagaccggcgttcctttggctacggatacgattatgctgtcccgacaagtatctttcgatcgcattcgtctattgtccggtgtgagcaacgacgaattgcaactgctcaaccctcaatacaaaagggggatcatccccggtaatacccagctgtgccgactacgccttcccgtcgcttccatcaagaaattggacaaggttcgcgattcgctttattcccccgacttggaggcttcggtatcggatttccctgagcaaggcggacaacactcgggaggatcgggacgaaccgccatcttccataatgtcaagcaaggtgagacgctcttgtccatcgccaaacgttatggcactacggtagcagccattaagagggcaaacggcttgaagtcctcctccgtcaagcccggtcagaggctgcaaatcactaaaagttcggcttccggcaccaagaaaaagagcaagtacagtgccaagcgaaagtcccgcaggaggaaataatcctccgccttcctcttccgaatagacccgaaccgtctatcttctccaagacgtatgacaagaagcctccggagaaaaaggtagtcgtataagcctgcgagcaataaaaaaagcggtgtgccggagtcgctgtttgggcgatctcggtacaccgtttctcttagagggtcttaagacctgattactgacgtccttccgttgtcgcttcaggagcaattttcttcaccaaaccctgcaatacatttccggggcctaactccataaagtggtcggcaccatcggctgtcatattcagcacactctgtgtccagcgaaccggtgccgtcagctgtgctatcaggttctttttaatctctgccggatcggtgacggcagaagccgttacgttctgatagatggggcagatcggctgactgatcgtagtctcctcgatggcttttgccagctcttcacgagccggttccatcagaggggaatggaatgctccaccgacagcgagcttaagagcacgcttggctccggcttccttgagcagttcgcaagctctgtccactccttctaccgaaccggatataacgatctgtcccgggcagttgtagttggccggtacgacaacttcatcggtcacttgggcacagatttcttccaccttttcatcaggcagacccagtacagccgccatagtcgaggggcgtacttcgcatgctttctgcatggccatggcacgtttcgatacgagacgaagaccatcttcgaaggtcatggcacctgctgcaaccaatgccgaaaactctccgagcgaatggcctgccaccatatcgggacggaagtcttcgcccatcgtcttggccagaatcaccgagtggaggaagatcgccggctgggtcactttggtttgtttcagctcctctgccgtgccgttgaagaggatgtccgtaatgcgaaagcctaatatctcattggctttttcaaaatatgctttggcctcggggttctgttcgtacaggtcttttcccattcctacgaactgtgctccctgaccggggaatacaaatgctttcatctctgtttcgttattgttttgattatgattccgattgttctgtttcacctctttaattcgtaagacctatctctaaaaacgatagcagatacctccgaactcgacttctactccttacactcgctccagtacttttaccagtacttcccatgtgcgagctacggattcgatatgaatcctttcgtccggagagtgtggcgattggagttcgggacctaccgagatcatgtccatatccggcattacgccttggatgataccgcattccagaccggcatgcatcacctgtacttcgggcttttggccgtaatactcttcgaagactttgctcatcacttcgagaatgtgcgactggatattaggttgccagccgttgtacgaggcgtcgaattccactcgtgctcctgccaatgagaaaacgctctcgatggccgatgctacccacatcttgtgcgattcggaagagctacgcaccaggaaacgtacggagattgacccttccttagccgtgatcaacgccagattggatgatgactctaccgtaccggggaaatcttggagcatggactgcgggccattgacgcaggcttccacggcattgatcagacagtcttggatctcttcgggaataatcattcggggacattcgatacgacttgcctcgaacttgatgttttcctctatgccgctgaattccttacggaacaaatcctggtagtcggataccagttcccagacagcttcggcctcttcttcctgaatggtgataacggcaaacgcttcgcgcggaatagcattgcggagcgatcctccctctacccatgccaagcgagcaccatagaatcctacagcctctttcaagaatctgaacatcagtttattggcattggcacgtccgaggtgaatatcgacacccgaatgtccgcctttgagtcctgtcaaagatatctttacgcctatttcttcgtccgaaaccagctcttcctccttatattcgagcgtgacattgacatcaatacctcccgcacagcctacgaagagcttgccttcttcctccgaatctatattgagcaggatgtcaccacgagagaacccgggcttgagaccattggcaccgtccattcccacttcttcattaatagtgaaaagagcttccagcggaccatgtttgagcattgggtctgccatagccgccatggcataagccactccgataccgttatcggctcccagagtagtgcctcgagctttcacccactctccgtcgatatatgcatcgatggggtctttggtgaaatcatgatcgatgtccgaattcttttgaggcaccatatccaagtgcgattggagggtcacgatcggtttgttttccatgcccggtgtggccggcttgcgaatgatgacattgcccacctcgtcctgctcggtctccaaaccaagcctcttaccgaagtcgaatacgtacttggtcacctcgtccatctgtccggtaggtcggggtatttgtgtcaggtcgtagaagtactcccagacagcttgtggtttgagggttttgatctctgttgacataactgtgaaaagtgttttggatgattgttgttaattgtttgactgttttatgcgatcgtatttcttattgacaaaaggaagcaagccgatagccacgaacccggcggccgtagtccaaacggtttgagtcgtgtgtaccaccaaggcaaacgctccggcatcttctttcgtcacgccgaaagccacaagagtagcaataaccatgaagtgccacggccctacgcccccctgtacgggtacggctacggctatgctgctcatggcgaagctgatcaaccccactcccatccccaacgatcgtgtaaagtcgaaagcaaagaatgtggtgtagaagtaaaagaaatatcctacccacaagaggatggaatataagatgaagagccacttgtgctccatatgccagatagaccgaagcccctccagtatcctaccgatgagtgctgctactttgcgaatggggcctacgtgtgagaggtatttatagagcaagaagaaaagtagcccgatacctacaacaacaacgtatagccagatggaactgaaaatggtgaaaaagccttgtgtcagttgtggattgcgagcgaaaaaagcggagaaaaacccttgaaagcccatcatgatactcaatgtgataagtccgaccatcaccaagtccatgatcctgtccataaaaagcgtaccgaggagttgggggaaaggtattttctcgtagcggctttcttccgcgcatcgccaaaattctccggcacggggcagagccatattgaccgtgtaattgcccaaagtagtcagaatggcattgattttccgtggatgaggagaagccaaaggttctatgaggagttgccagcgcaggccgcgtatacagttggcggccaatccgaacaagagagagaaagctatgatgtagtaattgacaccgtcgcggacgatcttgccaatggcggagaaatccattttgcggtacaccaaccagaggagcagaccgcctatggcgagaggaataatgaccttagctactgatttccatctgtcagacttatccgcgggcattatttcttgccctatattattagtcatttagttgctcttatcttgacaaatcattttgctatttagattacccttagtacgatcccattaaaataacaatcaaaatatcgtaccttagcattttctaaacaacgcaaatataaagaatttatatttcatgatgcgagtaaaagccaagaaggcactggggcaacacttccttcgcgatctgagtattgcagagcgaatagccgacaccctttccgagcataaagcattgcctgtactggagatcgggccgggtatgggagtgcttacgcagttcttacttcgcaaggggcatgatgttcgcgtcatagagatcgacggtgagtccgtcagctatttgcgagaagagtttcccgaactttccgatcggatcatagagggcgattttctgcactatcctttgtcggagctgttccccggaggacgacaatactgcctgataggcaattatccctacaatatctccagccagattttcttccgcctgttggacgttcgcgagcagattccctgttgttcggggatgctgcagcgcgaagtggctatgcgacttgcatcgcctcccgggaaaaaagattacggcatattgagcgtgttattgcagctttggtacaatatcgaatacctcttcaccgtagacgcttccgttttcgaccccccgcccaaagtgcagagcggtgtaatacgtctgacacgcaatgaccgcaaggaacttccatgtagcgagaaagccttgaaaacagtggtgaaaacagctttcggacagcgtcggaaaacgcttaggaactctcttcgcggtatcttgccggccggttttgatcgtttcgacgaacccgttttctcgaagcgaccggagcagttgtctccggatgatttcatcgcacttacactcctgttgcagcaatagcattttcatcccccctgattaacgaattcttatggacttcacgaaagaatatcttcacaatcttcgcgagatcatcgaccaaaagcgcgatgcagatgctctcgacctgatgagcaagctccaccccgaggatattgcggctctctatgacgagctggatctggacgaggctgtctacctctacctcctgctcgatggagaaaaggccggtctcgtactcttggagctggatgaagatgagcgaaacaaggtcctcgaaaggattccttccgagaccatcgccggaaaatttgtcggcaacatggagaccgacgatgcggccgagctgattcgtgagctggacgaagaccagcaagacgagattctcagtcaggtgaccgatatagagcaggccggagatattatcgatctgctcaagtacgaagacgatacagccggtagcctcatgggtaccgagatgataatcgtcaatgagaactggagtatgcccaagtgtatcgaagagatgcgtatgcaggcagaggatgtggacgagatatactacgtctatgtcatcgacgatgaagaacggctcaaaggagtgctgccgctgaagaaactgatcaccagcccttccgcttccaagatcaagtatgtgatgaagaccgagcctatttccgtcaaagacaatgacccgatcgaagaagtcgcggagaagatagagaagtacgacctcgtggctctgccggtagtggacagtatcggtcgtttggtaggccggatcactatcgacgatgtgatcgacgaaattcgcgaacagcacgagcgcgactatcagcttgcatcgggtatttcgcaagatatagaagcatcggataaggtctatatgcagaccgcagcacgcctgccgtggcttctcatcggcatggcgggaggattggccaactccatcctcttgggaggattcgattccctctttgccgccaatcccaagatggccctcttcattccgctcattggcggcacaggcggcaatgtgggcatccagtcttcggccatcgtggtacaggggctggcaaacaatagtctgaagcaggccaaactctggagtctcatagccaaggaagtcgtcgtagccctgatcaatgcctctatcatcagccttgtcgtcttcctgttcaactactttttcctcggtgacgtcctcgtcatgtctgccgtctccatcagcctcttttccgtcgtattgttcgccagcatattcggcaccatggtaccgatgctgctggatcgattgaagatagacccggccatagccaccggcccctttatcaccattacgaacgacctcatcgggatgatgatctatatgcttgtggccacgctgcttgctcaggccttgtaatttcggacgggacgagctatggggattgtcgaacgccagagtatcaaaggaaccctcgtcagctatgcaggtgctttcatcggcttcctgaccactttccttattatcaccgaatttcttacccccaaggaagtcggtctgacccgtaatatcgtcgaagccgctacgctgatcagcagttttgcgctcctcgggcgggtaccgag

SEQ ID NO: 1004 - DNA (genomic), 636 bp, PORYPHYROMONAS GINGIVALIS; double-stranded, circular
  misc_feature 1...636
  hypothetical: NO
  anti-sense: UNKNOWN
cccggcattaatcctaagacgaaaaaatctatttctatccctgcccgtaaggttgttcgtttcaaaccgggctctactttggaacttaagtaattcgcgctatttcttaattatacaacgaagctactactatcttaccgtgcagtagcttcgttgtgtattatataatagtatcgaacagcgaacagccttgccttgagagagggggagggctgttcgctttcttttggatcgggccgatttgaggactgaataggaaataaatgttttataagacaaatcaataagatgcagatgagaacatttcgtgtcgttgcgatcgtttcgctgatcttttcttcttggatgacgcttacggcgcaaaagaatagttggtgggtgggtgcccatgccggacgcgagtacttcaacaacacaagtgaggatatgaagaaaggatggaataccggagtagtcctgcgctactatttctccgatcgaatatattctttggctacactcaattatggattcgcttcttctttatccccttccggctatttcgatgagcttggtaacagtcccaatgcgcgcttcagacgccatagtattttgccggcagtgggattagggtatgaatttttccaaggcgatttt

SEQ ID NO: 1005 - DNA (genomic), 481 bp, PORYPHYROMONAS GINGIVALIS; double-stranded, circular
  misc_feature 1...481
  hypothetical: NO
  anti-sense: UNKNOWN
tctacagacttttctcattttcttccgatgccgagattaccttggaggccaatcccgacgatctgaatacaagctatgtacaggagcttcgtactctgccgatcaatcgaataagtatgggagcacagagtttccacgatgaagacctgcacttcctcaatcgtcggcacaatgcccgccaagtgctcgaagcagtggatacctgccgcaatgcgggacttaccaacctgagtatcgatcttatttacggtctacccgggcagacgcctgctcgctggcaagaaaatatctccgcagtgcttgctctctccccaccccacctgtccgctaccatctgatatacgaagaaggaacccccctgacacgcctactccatgcaggaaaggtgcgcgaagtggacgaggaggtaagcctcgaactcttccgcatgcttcgcgaacagctgacaggagccggtatgaacactacgagttcaattgcc

SEQ ID NO: 1006 - DNA (genomic), 693 bp, PORYPHYROMONAS GINGIVALIS; double-stranded, circular
  misc_feature 1...693
  hypothetical: NO
  anti-sense: UNKNOWN
cctgaaagtgtgtgggaaagcgaggtgaaaaatacgagaaaacggacttttgttgctcggaatgtgctctttggaagactgcctgacgatctgtatataaaccattttcaatttatatatagatcgttttcaatttatatataaatcgttttcaataaatatatatatcgtaaacgatttgtatataaaacgcaggccccaaaaggccttttcggggcatgataaaaagaagacacccgtcaggttcgtgacagaacctggcgggtgtcgtataggttaggagcgaaagagggttactccttatttgttaattgaaaaaatgtttatttttttatttcaatgcctatgaaggcggcaaaatctccaaattcaagtacacgtggacttggcttgtcgaaggggttcggcttcccatcagcttcgtatttgttacctgttttcaagtgtacaagcattaggcgtagctcaggggcctccaattctttgtttacccgaatataaccggtaaatccaacgggggtttcaagcaattggccattaatgacatctgagtagtaataggagatcccttttggaacttctgtttcgttgctcatcaggttgaagaaaaactgatgtatctcgatctgatcaggctgaaagaattgttggtttagtcggttgtctccttgtcgaaaagataaatctccattt

SEQ ID NO: 1007 - DNA (genomic), 658 bp, PORYPHYROMONAS GINGIVALIS; double-stranded, circular
  misc_feature 1...658
  hypothetical: NO
  anti-sense: UNKNOWN
cgcgttctacgccgaaatctgcgatttccgcacggcgaaggacatcgggatcgaccgtccggaaaagcatgaaattctgcatcacattccgccgacgcccgagcaggaagcctttatccaaaagctgatggaatttgcccgtaccggtaatgccgagctattgggtcgggagaaactctccgatcgggaagaaaaggcgaagatgcttatcgccaccgactacgcccgaaagatgtcgctcgacatgcggatgatctctccttcttacgaagaccatatcgacaacaaggcttcgcactgcgcccgactgatccacgattattaccggaaatatgaacgggagaaaggtacccagtttgttttctcggatttaggcacgtacaagccggacgagtggaacgtttacagcgaaatcaaacgaaaactgaccgatgattatggcatccctgcgtcggaaatccgtttcattcaggaatgcaaaacggaggctgccaagaaagcgatgatcgcgggcatgaatgccggcagcatacgtgtcctgttcggctccaccgaaatgctcggaacgggcgtcaatgcccaacagaaggctgtggcggtgcatcatcttgatacgccctgggtgcccagtgctctgagcacggatgcaggcatcgaa

SEQ ID NO: 1008 - DNA (genomic), 826 bp, PORYPHYROMONAS GINGIVALIS; double-stranded, circular
  misc_feature 1...826
  hypothetical: NO
  anti-sense: UNKNOWN
tgttcacgcttcgtgtttgcgactttttgcattaagttactaccgacaaagttagcatccagtctaagagcaggacgactctgagcatttgcaaaaccgattgttgcgagcagcatagtagctgccaaaatcattttcttcatttttcgttcttttttgagttttgttctacaatgtaacacactctctctcgttcaaaagtatgcctatacataccttccgatgcagcaaagatacacaatgaaacgtatctatgattcaaatggaagatttgcacttatcaggtggaatctgcaaaacgcgaaaaacggacaaaatattggatgatataaaattattacatacatttgcaccgcatttcaaacgaaaaaaatgctactaaggctgaatcgctagctcagcaggtagagcacatcccttttaaggatggggtcctgggttcgaaccccaggcgattcacgaaaagaaaggggccatgtcaaaattcggtttttttgaagtacgcctcaaaaagttggatattaaattatccttgtgttatagaaagagtccggtacaataccggactcttttcgtttaatcttgccttaattctactatttctattattgttatctcctccaatgcattgataaaactctcccgagagtcaaatttctctttacacaggagctatgaccgcataatacaaaaagaagttcttttcaagtgataataggacacggaacgagccatctgttttttaactctaataacaaggcaaaagtaatgtgttagagatcctaattgtagaacaaagagaccaaggatacagtataaactttca

SEQ ID NO: 1009 - DNA (genomic), 541 bp, PORYPHYROMONAS GINGIVALIS; double-stranded, circular
  misc_feature 1...541
  hypothetical: NO
  anti-sense: UNKNOWN
ctaagcggaatgccgaccttcggtatcgagctgggcgacatcgaacatcccgaatacacgttggaggagattttccggtatttggccgatgcggacaggcccctgtatcgttgccatcgatgagttccaacagattgcgaagtatccggagaagaatatcgaggctcttctgcgcactcatatccaaaagctccgcaactgcaatttcattttcgccggcagcgaacggcacatgatgcaggagatgtttgcctcggctgcacgcccgttttaccacagtgccgatatgctggagcttaaggccatcgaggcggatgtttatatcccctttatcgtagggcatttcgagaaacgccgatcgcagcatctcgcccgatgatgcacacgggtttaccggctcttcaaagggcatactttctatatacagaagacctttaacgaggcttttgcagacacgcccgagccgaagtatgtacccgggagatattcgagtcggccatcgataatatgatagcatcgaacgataccatattccgcgaga

SEQ ID NO: 1010 - DNA (genomic), 3085 bp, PORYPHYROMONAS GINGIVALIS; double-stranded, circular
  misc_feature 1...3085
  hypothetical: NO
  anti-sense: UNKNOWN
aatacgcaaccatggacattcaggattaaagagacgggaatcgacattctgcccgattttacaaaaacgctgcccgtagtcgatcctgataatcgagagctatttgtttcacttggatgcgctacggagaatctttgtgtagcggcagcccataaaggatacgagacgatggtctctatcgcagaaaacggcacgatccacatcgaacttaccaagcaggattccgatactccatctcctctgtttcctcatatatccgtaaggcagacgaacagaagtgtctatgatggaaatactattcctgtgaacgacattgtcgctttgggagaaaagagcgatatggaaccttgtgtcggagcccatttcttcaagaatggcacacgggagttcgacgctatttcggaaatggtttgtgagggcaacagcatacaaatgcgagacaaaaagttcaaagaagaattgcagcaatggatgcgctataacaagaagcatcaagatgcaacgagagacggactcagctatgccgtattcggtgcacccaatctgtctcgcttcattgcaaaggccattatcacccgactcattaatgagaagtcacagaatagaaatgatagaagaaagatagcctcctcttctcattttgttttgtttaccacttcgaacaatacggtggtgcaatggataaaattggggagagcattggaacatatcctgctcaaggctacaggtatgggtatttcgcatgcttatatgaaccagcccaatgaggtacagggcctttcgggaaaaatggcagaaatactcggcatcgaagacgaatatcctacggttctgatacgattgggatatgggagtaagatgccgtattcgttgagaagaagtgtccaatcctgcattatccctaattccttcgattgaaagaatcaagaggatacaagcctcaaaggtgatcccaccgaaaaatctctttggggccggacagaatgtttgagcatggctggcaaaaacgaagagggtgctgcaaagacgaaacgcttgcagcaccctcttgagctttcagccttttatcctccggcttatttcttcaggtgtttggcgaagaaaccgagcatggcacggtatagctccatggagttttcttcacgatggaatccgtggccttcgttgtacttcaccatatagggtacttcgaatccgcgggcacgcagtgccgttacgatctgatcggactcgttgatattcacgcgcgggtcgttggctccctgtacgacgaacagtggcttattgatcttgtcgatctggaagaagggggacacttccttggcgatagctgcttcctccggattgtcgaggtcgtaccaaatttccttgaccatttccttaaacggcttccaatattctgggaaggagtcgaagaaggtgtaaatgttcgatacacctacgtaatccacaccgcaggcatagagatcgggtgttttcaccagacccatcagcgtggcataaccaccgtggctggcaccgtatatggcgatcctgtcaggatccacccaaccttggctgatagcatagcgcacaccgtcctccacatcgtccatggctttgcgaccgatctgtttgaatccggcacggaggaattccttgccgtatccgcctgagatgcggaaattgacttgcagggtggcatatccgcggctggcgaagagctgggtctcgggattgaagccccatgagtcgcgtatgccttgggggcctccatgcggattgacgatcaggggtactttcttcccttcgagggctgctttcggcagagtgataaagccatggatagtgagtccgtcgcggctcttgaatttgatggggcgcatctcggccatatcttcctccttgagctgaggcatcaggtcatagaggagggtaaacttcttggtgcgcgtatcgaactggtagtaggtgccgtatagcttgtcgctttgtacggcgataagcaggatggtctcatcatcatcgtaatcgaccacggagaattctttgcccttgaattccttttccatcagcttgtgcagctctttgtaggtggcacttacgggtacgactacggacttctcgccttcgtaggccatgaggtctatttcgtagtttctcttacgagagaggtgcaggccgctgacgtcgtagtcttcgttggcgaagatctcgcggatgatcttgttctgcttcaggtcgtagagtacgatacgagtcttgtcgctgtccaggttggtcagtacataggcttcgtctttgtttttggaggcatagttgaacgcgatgactccgaaggtgtcgtcccagtgtgttttcttcagcagacggaactcgcccgtagccaaatccttgtagtacaactcggattcgatcccgtttacgaggcggctgtatccacgcagttcgccgtccttgtcgaactcgtaaccttgaatggggttggccgcatccttattctcgtagagctgggtcagctcgcctgttactacattcagtttgtagggttcgaagatctgcggattgtttttgttcatggatatgatcatgtagtccttctgctctttgagcatgttgaggatcgaagccttcactccgtcaaagggggtgagatcgcgggtattgctgccgtcgatattcgaagcaaagaggtgatagttctcattccctcctttgtccatgacaaagaagagacgttcgtcgttgatccatccgtagcctttgatcagttcgtccttttcttcgatggcacgcttgacggtgccggtggcaatttccttgacatagacatggcgtttgccggcatcgtccttttccatgtatgagaggtacttgccgttggggcttagctgaaaagcggaagccttgggtttggcaaagtagtcttctaccttgtatttgtagttgcccttgtccaaagctgccagtgccttaagctcttcttcggtcgaaggcaaggctgtattgccgggcaatttggattcgaatcgttgtagcgtaagcggcaggctgaagcccatctgctctacattgccttctatcgtattgccggacagggtgcccg

SEQ ID NO: 1011 - DNA (genomic), 4545 bp, PORYPHYROMONAS GINGIVALIS; double-stranded, circular
  misc_feature 1...4545
  hypothetical: NO
  anti-sense: UNKNOWN
gcctgctacacatgggtgcggagcacgccgtaatcggtatttcgggcggactcgactctgcactggcactgatcgtctgtgcacaggcattcgaccggctggatttgccccgtaagaacatcattgccgttacgatgccggggttcggaacttccgatcgtacttatcggaacgcctttgctctgatggaggccatcggcgtgacgatcaaagagatagacatcaaggaggcttgtctccgacacttcgaagccataggacataatccggaggtgcaggatacgaccttcgagaatacgcaagctcgcgagcgaacacaaatactgatgaatctggccaatatatacaacgctccagttataggtacgggtgatctgtccgaactggctctcggatgggtaacgtacaatggcgatcatatgtccatgtatgccgtcaatgcagggatagccaagactacggtacagattctcgtcgatcatatagcgcatagcggctggctggatgaggcagcttcggctgttttgctggacatcgtccgtactcccatcagtcccgaactcaagcctgtgggacaggatggaaatatcagccagaagacggaagatctggtcgggccatacgaattgcacgacttcttcatctaccatttcctccacaatgaatacaagccctcgaagatctactacctcgccggtgtagctttcaaggggatctataccaaggcggagatcaagaaatggatgatggtattcttccgtcgtttcttcgctcagcagtacaaacgtaattgtatgccggatgggccaaaagtaagctgcatcagtctgtcgccccgcggagcatggcgtatggccagcgatgccagcagtgcgctctggttagacgaaatagccaagttcgaaacggattgatcttttggagggtatccgctcggaaaagacagaggcagtgtccaaatactaaagacactgcctccgtcttttttcctccatggaagtgaggagagagagaagagaatgctgcaagtgcgtcggccttatgaccggatttacagaggctctctcgaatttacaatcgacactctcaacaagaaaaagcgactacttgtattcagcccaactcttgatgcgaatatcctcagggctatgtttgcagaatgccgtgatgaaggcagaagccaaacgagcatttgtaaccagcgggatattcaggtcgatggctgcacggcggagtttataaccattggtcagttctcctgcggtaagattcttgttgatattgaccacaagctcgatctcacgattgtgaagcaattccagagcttgaggctgtccgttctcgctcggccagaacactttggtcgattcgattccgttctctctgagaaaattgtgcgttccctccgtggcatagatcttataccctttggctgcaagcatggtcgtagcatcaagcatatccactttttgcttatagcctccggtagataagagtacactcttctgaggaatgcgatagcctaccgaaagcatactcttcagtacagcctcgtccgtatcatccgctatacagcctacctctccggtactggtcatatccacacccaagacagggtcggccttttgcaagcgggtgaaggagaactgcgaggccttgataccgacatagtccagatcgaactcgctcttgttcggcttctctaccggcaggccgagcatgatacgtgtggccaattcgataaagttgatcttgagcaccttgctcacgaaggggaagctgcgcgaagcacgcaaattgcactcgatcaccttaatatcgttacccttggcaaggaactggatattgaaggggcctgatattttcagagcttttgctatctcacgactgatccgtttgattcggcggacagtctctacatacaatttctgtgcagggaactggatagtggcatcacccgagtgcacacctgcaaattcgatatgctcgctgatcgcataggctatgatctcaccatcacgcgccacggcatccatctcgacctccttggcatgctcgataaactggctgacaacgacaggatgttgcttggacacattggcagccaattcgaggaaacgatgaagttcttcatcattggagcacacattcatagctgcaccggaaaggacgtagctcggacgaaccaaaacgggataaccgacttcggcaacgaatccgtcaatgtcgtccatcgaagaaagctcctgccaacggggctgatcgatacccaatttatccaacatggctgagaatttatgacgatcctcggcattgtcaatactctgtgcggaagtacccaggatgggcacatgctgttcatcgagacgaactgcaaggttgttcgggatttgtccccctgtggaaacaataacgccatgaggattttccagttcaagaatatccattacgcgctcgaatgtcagttcgtcgaagtagagcctgtcactaatatcatagtccgtactcaccgtctcgggattatagttgatcatgacggagcgatagccttccttacggatggtagccagagcattgacaccacaccagtcaaactccaccgagctaccgatacggtatgcacccgaaccgagtacaactacggaacgcttgtcgttctcataggctacatcatgacgatcgccactatacgtcaggtagagatagttcgtatgagcaggatactccgctgcaagcgtatcgatacgcttaaccaccggtaggattcccagctcctttcgcatggcacgtacctgattggttgcgctttccatcgaagtagcatccggcttgagtacagcacgagctacctgaaaatcggaaaacccgcgcaatttggcctcagccaaaagagcaggtgaaagatcttcgagcttgtcgaactcttccatttcctctgcaagggtaacgataccatagagtttttccagaaaccagcgatcgatcttagtcagttcatgtattttatctaccgtgtaaccttgacgaaatgccttgcttatgacgaaaatgcgtctgtcggtcggctcattcagtgccttgtctatattgggaatcacgagctctttgttctctacgaaaccgtgcatgccctgaccgatcatacgcaatcccttctggatagcctcctcgaaggtgcgaccgatggccataacctctccgacagatttcatagaagaacctaattggcgacttacaccgtggaatttacccaagtcccaacggggaattttgcagactacatagtcaagagccggctcgaagaaagccgaagtagtctgtgtcaccgagtttttgaggtcgaacaagccgtaacccaaccctaacttggcagcgacgaaagcgagaggataacccgttgccttggatgccaaagcagacgaacggctcagacgagcatttacttcgatgacgcggtagtcctcgctatcgggatcgagtgcatactgcacattgcattctccgacaataccgatgtggcgaatgatccgaatggccagctcgcggagtttgtgatattcactgttggtgagtgtctgcgagggagcgatgacgatactctctcccgtatggatgccgagaggatcgaaattctccatattgcacacggtgatacaattgtcgaaacggtcgcgtacaacttcatattctacctctttccagcctttgaggctcttctccacaagaacttgagggctgaaagaaaaagctttttcacaaaggatattcagttcgtcttcgtcgtcgcagaaaccgctacccaaaccgcctaaggcataagcagcgcgaacaatgacgggatagcccaattcgcgagcagctttgcgcgcttcctccacgctttctacagcttggctctggatcgttttcacgttgatctcatcgagcttgcgaacaaaaagttcgcgatcctcggtatccatgatagcttgtacaggcgtaccgagtacttctaccccatacttttccaagacaccgcttcgatacaattcgactccacagttcagagctgtctgaccaccgaatgccaagagaatcccatcgggacgttctttctcaataactttctctacgaaataaggcgttacgggcaggaaatatatttcgtcggctatcccttcggacgtttggactgtggcaatattcggattgacgagcaccgtcctgataccttcttcgcgaatggctttcaacgcctgagaaccggaataatcgaattcaccggcttcccctattttaagtgcgcccgaaccgagcagcagtaccttctttattttgctcttgtctatcatattcgtatgcttctttgctttgaggtttttcaagaattcatcgaaaatgaacattgtatctacagggccaccgcatgcttcgggatgaaactgtgcagagaagaaaggcttgctcttgtggcgaataccttcgttcgtgccatcattcaggttgatataaagctcctcccaatcacttccgagagatgccggatctacagcaaatccgtgattc

SEQ ID NO: 1012 - DNA (genomic), 2624 bp, PORYPHYROMONAS GINGIVALIS; double-stranded, circular
  misc_feature 1...2624
  hypothetical: NO
  anti-sense: UNKNOWN
gaaaagtgatatgcttcataatcccagcctgcttaatccattttttcaaaggataattgatcatactgcgctgcaagcctttgaagactttacccgatgatggctctccacatagttcataagcttcataactgattgggagagtagcttcggtagaggtcttctgtgtcctgatgcggatgcaatagccttggtcaggagcaagagtgaaatcttcccatcggagattgagaatatcgctgatgcgtagccccgtaaggcaagagaagagagaagctcttttcagaacatcatgctcacagggtgtctgagcaagtatcttcacttcatcgagtgtcaaatactctttcttgacctccttagcttctatcttatctaaaaagtcattgatattctcccttagccacttatctcggtacgcaatcttcagtagcccccgaaaagtggaatagtagccagatgcagagtttgtggagacttttccttttcgtttgagttgcttggcgttgagaaggtactctcgaaaaccttggcatagctctatcgttatgtctccaaatgtgcaatgtccttgcacatagttgtaaaagtgttgatagacgatgcgccacttttggtctttctttcgacacattttcaagaagtatgcaaggaagtcggttttcattttagttcgatcaagaaagccaaactcttcattgataagcgactgtacacggatacatcgaatagcttccgccttgttcaacatatccatgttaaactctcgctccatctcattcttaggatgggcgtagatatagatgccgagatactcccgacggctcatttgcatggtttcgggattgcgcacagctggataataatcgagatagagcgatatacgcccgtttctgatagctctctgtcggagcgttactttgggacaagtatgtctcatacaattgttgattagagggttatatttattgattcagttgcaaaagaataaggtgataagagggtgtcccataccaccaacaaataacttatcgagtgatgctgggaggtttgaggacttcatccaattcttgctgagaaatgaggacattccgaccttgctttagtttaggaacattataacgtttggtatattgatagagctggtcacgagtaagaccaaacttttccatagcctcccgaacagtatagtagcttggagctgccttatcaagcactcctttagctgcttcgacatgtttggtggaatagtagcttttacccttgactttctttctggggatgttgtgatcagagatgaagttgtaaacggctgtgagcgtcatatcgaatctttcttgtatctccacggctgtacaccattcttcgatatgagaagcaggagcctgtttagcaaaataggcatctatatgccgtttgctccaataggtcttgcctctgttataagttcgagggatattctctcgcttggctattgcaaaaagagaagatcgagatatgttgtggatatcgcacacctcgtctgtcgtatatagttccgtaattacgattgcatctctgggctgtcgtttctcataaggtcgctctgccaacatccgttcaatgtcttcacgcttgacgattgagcgttgagaactcaaattataagcctttaagttccctgagtagatatatctatatattgtatgcctactaataccaagtaatcgcccagcttctgagatggagagataaggtttgtctataatatcactgacctttttctcttgttcagaaagttctgttctgcgtaccctctcttctcttttttgagctttgtaggctctgctattacatctatgtgagcaatacttggtagtcgtcttcaaagctataaactcctgtttgcaatgctcacacactttttttattggaattttgctcgctgtcatttcgccatatttttgttttgtactgtctattggtgttgcaccgtgtctcatttgtccagtatctcggtatatacgcgaggggctggagggttggcgagctgcgtgcggtacaaataaggtacaagaatgagcgaaagaaaggctccgaatgatgcctaacgaacagaaagggcaaaaagaaaggcgctcataatgaacgccttttcgatatttggtgatatatgattatcggttgtaatcagaaattacttgccgatgcagaagtgggcgaagatgtagtgcagggtgtcgtcgctggtgatttcgcggccggtaatttcgccgatggaggtgatggcgtgccttaggtcgagcgttagcaagtcggtcgagagtcccatatcaaagcccaaacgcattcgccgaagggcatcgaaagcctcccgcaagagctgatgatggcgggcattgctcacaatgaggtcggcttcgttcgcgccagaagtctccatgatctgggtaagttcacccttgagttcatctatccccctaccctcacgagctgagatgaatatcggtttcgtgggcgtggagagcttcgtttgcagagtctcgctgagtccgattcggtcggcctcggcgaggctttcgcttttgtttacaagtagaatgagggttcgctcctccctttcgtcccaaatgctggataccgag

SEQ ID NO: 1013 - DNA (genomic), 2858 bp, PORYPHYROMONAS GINGIVALIS; double-stranded, circular
  misc_feature 1...2858
  hypothetical: NO
  anti-sense: UNKNOWN
ggccgggaatctgcgcacagcccgttatatgtcttggctatggcattgaagtcctgacgtgctaccgtgattctgttttccgtaccctcaagttgcacttgcagatcgcggaaattctggttagccttgagatcggggtaacgctccactacgaccatcaaacgggacaaggcactcgatagctgatcctgtgactgctgaaacttagccaagttctcttccgtcagattgtcggcattgatattcgcagcagtggctttgctacgtgcttcgatcacggcagtaagcgtttcgctctcgtgagcagcatagcctttgacggtctctacgagattcgggatcaagtccaaacgacgttgatattggttttccacttgactccaagccgtattgacggcttcctgcttgtccacgaagccgttgtatttgagcacaccccagctaaatagcaggacaaaaactgcaataatggcaatgatgattactgttccttttttcatattcattctatgtttacgttactattaggtttatctgaatgtactacttacgacgtctgacaggcgttttgtctttcttgaccgaccagccgaaatagccgagaaagtccccaagcgagaagtattcgccatgcgaatatgccagcaggtttgctttctccatatcgaaagaacctgtctccgggttgatatattgttcgtcggcacggatattgaccacatcggccataaacatgtcatggctaccgagtggaatgacctgtcgtaccttgcactctatgctgaccggcgattcggccaccaaaggagctttgatcagcttggccggctccacggtaaggcctgtctcggcaaacttgtcatagtccttgcccgaacggacaccgcaccagtccgtctgtctggccatgccgaccgtagtcaggttcaaaccgaactcgccactctctttgatgagagcataggagtgacgctccgggcgaatactgacatagcacataggcggctggctgcatatcgtccccacccaactggccgtaagcaaattataatcctccggccgggagccacaactcaccaatatggccggtagcggatagataagtgtgccgggtttccaatcttgtctcattgtttcattcttagaaaacttacgcaaactatagcaactcgatgcggtcaccggctagttttcgctcgcagtagtcgcatcgaagggtgcactgctcggcatctatcacacggaatcgggtttgcatcggttcgttgttcgtaatacacttcggattcggacaacggacgagacccacaatctcgtgtggtacttccacctgacgtttttctacaacttcatagtcccgaataatgttcaggcgcacattcggggcaataagagcgatgcggttcaattcctcctcttcgaaagtcttgtcctctatcttgataactcctttcgaaccatggctccgactgcgcaaattgttgccgatggtgatccgcttgtccaaatcatccagttgcaggagagtagccaccttgaacagtttcgtcggggggatatggtctatcacgatgccgtttctaatcgcggcgacgagcatttcttcctttttcattacaatatctgcttagtttgcaacgtctatgccgagcacttcacaaatgatggactgcctcgtataaagcccgttcagtgcttgccggataaagtaggctttgggattgtcatccacatcataggcaatctcccccacacgaggtagcggatgcagtacgcgcagattcggacggctgtcggacagcatagcgttggtcagcacatagacatctttgacccgttcatattcctccagatccgtaaaccgctcacgttgtactcgtgtcatgtagagaatgtcgcagttgttgatcacctcttcgtcgaaatgtttggtttccgtataaggcagatcatgctctcgacaaaactgcttgtattcttccggaagagacagctcttcgggagcaacgaagatgaaacgagggcggaagtgcgacataccctctatcagagaatggatagtacgtccatacttgagatcccctaccatagcgatagtcctgtcatacagcgtgccctgtgttttgcgaatggaatagagatccaataaagtctgtgaaggatgctggttggctccatcgccggcgttgactaccggcacacggcttacctccgaagcataacgagccgccccttccagatagtggcgcataataatcagatcggcatagttgcccaccatggaaatggtatccttgagcgattcgcctttcgtagagctggaggtggatgcatccgaaaaaccgatgatacggcctccgaggcggttcacagccgtctcaaaactcaggcgcgtacgggtagaaggctcaaagaaaagagtggctacgaccttaccctccaaaaggtgccgattcggattcttttcgaatagctctgcccgatcgagaatgcgaagaatgtcctcggccgaacactggtcaatagatacgatatgcttcatcttttaaggagtataattgattgaatgatatggacggaagcaaagctcacttcaaagcgaaagaagccttaaccgttatgcttgccgtcttcatcttggaagacgtattgaacgaacctccccagctataatcttcgttcgagttgagccccactatctggaacacgcccatcgaagaagatagcatcttacccacggaggaaccgctcccctccgcaatgaccgaagcacgattgaaagcgtcttcggaggcattgcgcagcatctccaccttcagatcattgagcttggtgtagtaataggcccggacggtcga

SEQ ID NO: 1014 - DNA (genomic), 2601 bp, PORYPHYROMONAS GINGIVALIS; double-stranded, circular
  misc_feature 1...2601
  hypothetical: NO
  anti-sense: UNKNOWN
aaagaggtttatcgctttgacttatatctatggtatcggccgcagtagtgctattaccatttggataaagccggagtagaccgcgatatcaaggttaaagattggtcggatgaccaagctgctgccattcgtgatgttatcggtgccggatacaaagtagagggagatttacgttctgaggtgcagttgaatatcaagcgtctcatggatatcggctgctatcgtggtattcgccatcgtatcggtctgcctctgcgtggccagagcacaaagaacaatgcccgcacacgtaagggcaagaagaagactgttgctaataagaagaaagctactaaataataaagattgatatggcaaagaaagcagtcgcaaaaaagaaagttgtaagggtggaagcagtgggacaggctcatattcattcttcctttaacaacattattatttccttagcgaacagcgaaggtcaggttatcagctggtcttcagccggtaaaatgggatttcgttcttcaaagaagaatactccctatgctgcccagatggcagctcaggattgtgccaaagtggcatatgatatgggcttgcgcaaggtaacggtctacgttaagggcccgggtaatggtcgtgaatcggctattagaacaattcatggagcgggaatcgaggttatggagattattgatgtaacgcctatgcctcataacggttgtcgtcctcctaaaaagagaagagtttaagagagaagatcttctaacatttcggacgctctattttatgggatccgaattctttcggtgtatggattgcctataaactatcaatctctcacatagcaatcgcggctgtaccggaagcattctgttcatagaaaagcatctgacacaaaacaaacaataatggcaagatatacaggccctaaatccaagatcgcgcgtaagtttggcgatcctatctttggtgcagataaagttctttccaagaagaattatcctccaggtcagcatggcaataaccgtcgtcgtaagacgagcgagtatggcctccagcttcgtgaaaagcaaaaagcaaaatatacttacggtgtattggagaagcaattccgtcatttgttccatcgtgcacagcgcgcaaagggtgtaacgggtgagttgcttattcagttcttggaagcacgtttggataatgtggtgttccgtttggggattgccccgacgcgttctgctgcacgtcaattggtttcccatcgtcatattaccgtagatggcagtgttgtcaacattccttcttattctgttaagcccggtcaggtgatcggcgttcgtgagcgttctaagtccttagaggttattgctgatgctttgacaggtttcaatcacagcaaatatccttggatggagtgggatcagtcgtcattgtccggtaagctgctgcatatgccggatcgtacggacatccctgaaaatattaaggaacagctgatcgttgaattgtattcgaaataatccatagatcccatggcaatattagcatttcagaaacccgaaaatgtattgatgatggagacgtcggactcgatcgccaagttcgagttcaaacctttggagcccggttatggtattaccattggcaatgcgcttcgtcgaatactcttgtcttcgcttgaaggttttgcgattactgcaatcaagattgaaggtgtagagcatgaatttgctactattccgggtgtattggaggacgttactaatattatcctcaatctcaaacaagttcgttttaagcagattgttcctaatgccgatgtagagaaagctacaattgttatctctaattcggaggtgttccgtgccggtgatttgaatgcacaactttcaaactttgaagtgttgaattcgaatcttgtcatttgccacctcgataagtcggctacgcttactatggagttttccataaataaggggcgtggctatgtgtcggcagaagagaatcgcgcagagcataatgagctttccacgatagcgatcgactcaatctatacgcctattcggaatgtcaagtatgcggtagagaatttccgcgtagaacagaagactgattacgaaaagctcctgatggaagtgaccacagatggttcgatccgtcctgtagatgctcttcgtgaagcagctcaaatcttgatatcccacttctctctgtttgcagagaataagatagcgatagagtatgtggatatagtcgatactgatgagttcgatgaagattctctgcatatgcgtcaactattgaagtcaaagctttcaggtcttgacctgtctgttcgtgccctcaattgtctgaatgcagccggagtagatacgttgggcgatttagtgagtctgtcacggagcgatctgatgaagattcgcaacttcggaaagaagtctttgactgagcttgacgaactgctggcaacgctgaatttgtcgtttgggatggatatcagtaagtataaattagataaagactaagaacgatgagacataataagaaattcaatcacttgggccgtaaggctgctcaccgtaaagcgatgctgtccaatatggctgcttcgttgatccg

SEQ ID NO: 1015 - DNA (genomic), 2793 bp, PORYPHYROMONAS GINGIVALIS; double-stranded, circular
  misc_feature 1...2793
  hypothetical: NO
  anti-sense: UNKNOWN
tgcgtcttttattggtttgccaaatatcggtaaaggtgtcttccacagtggcaatcaaagaaaagaccgtgtagagcagtacgataagaccgacaccgacgaagataccgccttgcacttgtgccagatagttttccacatagcctaatgcctgttccaactcctgctgatgaccagggagatattctttgagccaatcatgtaccacctgctgaataccgaaacccttggcaataccgatcaggacggcaagcatcggtacgatggagaggatcgtacggtaagtgagagcagatgcctgtgtagccagatcattttggataaagtagcggatcgtgaggaaaacagatttgaaagaattgatcatcaaccgacttggtaccgaaacctcttcgtccgttatgcgccacatatctcgggtgacaaaaagaatcattcggtttatccggatggaccaccgcctgaaaaagcccttatcgttctttttctctttctcgtcaatgctctctttcatacaaatcaatgagttaaataccgttggtaaatcaatgtccggcatatctcaccccaaggagattgccgaagaaagaggaaaaaagcagcagatctgtaagccgggttctgtactcacggccacacgtagccagagcgtctgtcatttatcttggccgtgcgtcaccgcatggctccagcgatctaccccccggcatcgggcgagccaccctacatgcgccggtatacatgatcttacaacccatcagacgtacggcatgcagcgtcaccgctgcatccggtaggctcttaccccaccttctcacccttaccctccacgtagtccgtaccgaagcacagacaactcatggaaaatggcggtcattctcttctacgctcctttaccctcacgagtaacttcctgttaggaaggatggtgctctgcgttgcccggacgttcctcccactctcgaaagagtgagcgacagaccgatctgctgctaatcttttctttcgtcttctatatcttatctatgtgccacctctacgaccttggtcggatcaagatgttcattgcgatagtccacttgctctaccactcgggcagccaattcgcggaaagcaattcccatcatcgaatcatcccgaacagcaacgggtattccttcgtccccgctttggcatataccctgcaccagcggaatctgtccgagcaagggaatattcaactcctcggctaaattcttaccgccatcacgcccgaagatgtagtatttgttctgtggcagttcggccggtgtgaaccacgacatgttttccaccaaaccgagtaccggcacattgatcttctctccgacaaacatactgattcctttccgagcatcagccaaggctacgtcctgcggtgtcgtcactacaacggctccggtaatagccagcgtctgtacaagtgtcaggtggatgtcgctcgttcccggaggcatatcgatcaggaagtagtccaactctccccaattggcatcgcggataagctgtgtcagggcattgcctgccatacttccgcgccagagaacagcattgtccggatccacgaagaatccgatagagaggattttcacgcccatcacctcttcgggaacgatcaattcgcgtccgtccacttcttcaagtacgggacgtgactcttcgcagtggaacatcttaggcatagatgggccgaatatgtcggcgtccaaaagtcctacccgatagccggatttggccagagagacggccagattagccgtaacggtactcttcccgacaccgcctttgcctgagaaaacagcaatgatattcttcaccccgggcagaagtttggccggaggagcaggtattgcctgtttgctcttgacagagatattgcctttgatattgacgtcttcgctgatatatgtcaggatggctgattcagctgctttgaccactgatttgatgaatggatcgttcgctttgtcgaatatgagtgaaaacgataccttattgccatcgattctgatatcgtcctctaccattccggccgaaaccaaatcttttcctgtccccggatagcgaactttaccaagggcttcgagaataagattgggatataatgttacgtatgccatgttctgagtaggttatttattaggaaggaactgcctgacttcttctggagcgattgtaactgcggtagctgtcaggttcgatttcaatatcgggttctcgatactcgcagtcaggttctcccaagccaaagctgatgtacttgatcgtcagacctcgttccagccactgttgttcgtaatatgttcggatgccgaggatttcattctctacgcatcctttgccgtacagatcatccgttatctcgtgtacgggcaggccgttgagttcgaccaacgccttcgtataggtatagaggaaagggctatccgttttcagatggatacgtccccccctttcgagtactttgtcatagagcgagaggaaccgcgttccggtcagtcgcttgcctactttcttcatctgcggatcggggaaagtgatccatatttcggctacctctccttcggcaaagaaccgatccaaaagctctatatccgtccgaaggaaagctacgttggacatcccttcttgaagagactctttggcaccggcccacatgcgagctcctttgatgtcgatgccgataaaatttttctccggaaaccgccttgcccagacctaccgtatattctcctctcccgcaacccagttccaagactatgggatgatcgttgt

SEQ ID NO: 1016 - DNA (genomic), 1254 bp, PORYPHYROMONAS GINGIVALIS; double-stranded, circular
  misc_feature 1...1254
  hypothetical: NO
  anti-sense: UNKNOWN
atgtaagctcttcccgattgaattcttgtccacttccggatcggtttgaatcatctctttcaagagtccgttttcattatagactagtttgtcgtgcgcagatcgccccatacattggccataatgtcgaagaatctatatccgctttgatcagtttcatatcggcatcgtaggaaaaatcgatacggatatcctctatcaactcctgacttccatctttaggcgagtatctgctgaaatgagtgatataacccttgtcatcgcggacaaattcccattttctgacaggtatctgaacggttccatcgtattcctcctcacgaatcatatatccgccttcattgaaaaagaatcgtctttcgtgttcgatctctcccgaagactcatccaccgaatagatcctttgcagacggttgtcgactccgtattcgtaattagagtaggaggagaagcttttttcttttacaatcctgtgtttgaattgctgcggatcggcatggaagtaatttggagccattgtctgagcattagcgctccaaatccatgcacataagaaagccacggaggccaaaaaaagttttttcataatgatttttctcattggttattagcgacggcaaaggtatcggccgccatcagacaggccaatacctaccttagggtattcttttcacttatttggatggaattaggtatttctgacgatattcctaatagtttgctgttacctcttgaggatattccttataggtgtctcctatatggagacctttgcacaacaagcaggcattttatccattcattttattgtgtaccggccgattgttttgtgtgtttatggtatgatcaatgacacaaaacgatggtacgacaaggaaaatcatccgacgagaagaggtttcattcagggacgtcatgccagcgaatcgatacgggaaagcacggaatgtatttttgacccaagtcgatacgcttatatgagaggatactatggtctcctatgagaggatactatggtctcacatgagaggatactatggtctcctatgagaggatctatggtctcctatgagaggatactatggtctcctatgagaggatactatggtctcatacgagaggatactatggtctcatatgagaggatactatggtctcgcatgagaggatactatggtctcctatgagaggatactatgatctcgcatgagagggtactatggctattgatggaagatgctatctgctctctgc

SEQ ID NO: 1017 - DNA (genomic), 1665 bp, PORYPHYROMONAS GINGIVALIS; double-stranded, circular
  misc_feature 1...1665
  hypothetical: NO
  anti-sense: UNKNOWN
ggcatggatatgctgaagattgacggcttcacgtacaccctgagccgtaaaacggacataatcagcccctgcatctataattcgagctgcctgatcgacagatgcctgtgtgtccatggtggacacattggccatagattgtatgcgaatgggaaaatctccgccgagaggtgtatcacctatttgagctacggatgtcttgcgtcttttatatccgaacagatcgagcatagtcttgctatattctttggattgccgattcgagcgggaacgactcacactacttcgaaaagataatagagaaaaagaaaggcagactacagccgatagcggctcataaataagccacggctatagactgccgatcttttttgtgccgaagaccaacggggcaggacagggctttaattcgttttgaagttgtacttcacctctgccagctcgcgattggccttaacgactttttctttgagcgactccttataggcctccagtcgagcatagagagcttcgtcgccggtagccatcatctggacggccaaaagtgctgcattctgggcagcattggatcccacagtagcaacggggatccccggaggcatttgaacgatggctaacagagcatccattccgtcaagagtggcattgatgggtacacctattaccggaatagacgtcatggaagcaattacgccacacaaatgagctgccataccggcagcagcgataattaccttgataccgcgagctctggcctcgtgtgcaaaagtctctacttcagccggagtcgattgagccgaaagcgccaacatctcgaatggaatctgcatttcatcgagcattttggcggctttctccataatgggcagatcggaagtactacccatgatgatgcttaccaaaggctgcatttattgagctatcagtttttcgtattcggcagcactcaggaggttgtcgaagtcggcagcatttgcagccttaaccttgataatccaaccggcaccgtagggatcgctgtttacgagttcgggttgctcttccagatcagggttcacttccaatacctcgccggcgataggcatcatcaggtcggaaacagtcttcacagcttcgatcgatccgaaaacctcatcagcctcgagcgtttcgccttcggtagtaacgtccacatagacaatttcgcccaattcgccttgagcatagtccgtgataccgatgaagacaacgtcgccttcttggcgagcccactcatgatccttagaatacttcagttctgcaggagttttcatttctaattttcttgttgattatgttttgaaaaaatgcttttgcaaagttagtcaaagtttacattcgtacagcgaattgctattcgttgtttttgcgacttttagttcgagaaaaactatcctgttttattgggttgatgttattggattactacgggagaaacggatcaatggaatataaaatggagtagctcccgaagcaaatccccactgccggcaaatgtgccggtcgtatccacccccttactgcgggcatccgtcatccggatctcgtgtataatgtctaaaaccttcctcgtcgaatacatcttcagccctgtcatatagtcgcgcacttggaaattgcgtatcgacaatgctttcatgatagcat

SEQ ID NO: 1018 - DNA (genomic), 844 bp, PORYPHYROMONAS GINGIVALIS; double-stranded, circular
  misc_feature 1...844
  hypothetical: NO
  anti-sense: UNKNOWN
aagtagctgtggcacaagctcccatatctgtcattggcgatacttctattcgtgccacggatgaggagatcaaaaagtactacaacgaacncaaagagttcttcgttcagaaatatccgtctaccatcgtccagtatatcagctctcaggtagtgccgagtgctcaagacatggcaaatgcagaagtggagatgcagaaggtacgcaccgagatgcaacagcaaagcgatgtggaagctcttgcccgcaactattcggacaagttcgtatctccttctttcctgacttcggcggaactcgatcgcatgaacctcggcgtaagcattaccgaatttatcaagactgcgacaccgggcgaagtcaatatcccgatgttggagaataaccactattctttggtaaagttggtggctaaaaagtccggattcgaatcgctcaatgtggcaatcattgctctggactccgccaatctgtctaaggccgacagcctttgcaacgccttgaatgaggggggcgacttcgctgctgcagctcgcacgttcagcgcagatcctacctctcgtgagacaggcggtgtactcacgttccccaaccagtttacacaaatgccggatagcactattacagaggctatggctcagcagctgcacctcgacactctttttagcgttccatcgaatagagtgatcaaaatgaatcaggataaattcgttttcctggccaaagctttcaatcccaagccggctgtagataaatacaaaattgcctatatcggagtagatgctaatttttctgatgagacatacaataagaagtttatggagctgaacgagatgttgaactc

SEQ ID NO: 1019 - DNA (genomic), 1802 bp, PORYPHYROMONAS GINGIVALIS; double-stranded, circular
  misc_feature 1...1802
  hypothetical: NO
  anti-sense: UNKNOWN
gttgccagcaacctccctcagaactgtgactacttggttatttacgatgatatgttcaacgtaaatcaacaaccacacgacgaaatcaaacggctgtgcgaacatagagccttctacaacggctttgatgtagctgctgtaagtataaaggacgtattgaatagcttcccatcaaatgccacctcatacatcaacgaaactaaactgaaaaatttcattcgctcagtttacaaccaaagcaatgcgaagaggactttagatggcaaactgggatacgtgctactgatcggaaaaccattgagcaaatatttggctgacactgataatacaaaagtcccaacctcttttattcataatgtctccttaattccaagtcatccaacttttggttccatatgcgcctccgactatttttttagttgtgtttcgccccttgatactgtcggcgatttgtttatcggtcgatttagcgtcaccaatgctcatgaattgcacaatctgattgaaaagactatcaacaaagaaatctcatataatcctattgcacacaaaaatattctttacgcagaagggaaaggctgcgatgctccaatcttacgtttattcttaaaagaaatcgcctctggttacacagtcaactctatcttaaaatctaatcaggtctctgcaatagactcgatatttgactgcttgaataatggttcccatcatttttattttaacactcatggaatgccgactgtttgggggatagggcagggactcgacgtcaatactctaacagcccgattgaacaatacatcttcgcagggattatgtacgagtctatcatgtagttcggctgtagcagattcaactattagatcgcttggagaagtcctgaccacatacgcacctaacaagggattctcggctttcttaggaggaagcagagccacccaatatgccgtttatttagaaggcccctgtcctccgtcagaattttatgaatatttaccttattctttatatcacaatctctcgactgttgttggcgaaatgttgctatcatccattatcaatactaattctgttgatacgtattcgaaattcaacttcaatttgcttggcgaccctgcactaaacattatggctcatggcatggaggttagtaattgtattacactaccaaacaacaccattataagcagtccgataacaataaaaaatggtggctgcctaaaaataccggaaaaaggagttttgcattttactaataatggctccatacaagtcatgtccggaggaactctggaaataggcaatcaggctaaaatatccggagagaccggtgctaaccccacctttattaccgtttacggcgatggtcttgcgattaacaagcaggtagagatagacaatatagaccgacttaacttgttttctacgcattcggtcatgcccaaatttcattttgacagtgtgaaattcaacagtgccccgctgtatacaacgaactgtattgtggagataagcaattgcgaatttaccaatcgaagtgacattatttcaaagaattgtgacctaagcgttgaaaacagtatgtttagcagttcggggataacggtattcaagcctatggctacaagctccatcaccggattatctacaaaagcaaagattaccgacaatactttttttgcgacaggaaacttcgcctaccatatcacaaacacgccaggcttaacagcaacctccaatgctgccatcaagttagacaatattcctgagtattaccatttccggaataaaatagtcaatgc

SEQ ID NO: 1020 - DNA (genomic), 3412 bp, PORYPHYROMONAS GINGIVALIS; double-stranded, circular
  misc_feature 1...3412
  hypothetical: NO
  anti-sense: UNKNOWN
gttcacttcattttttttgacacagtcctatattttctgaaaaagcttctatttgatcctcaaggctttgcccggagtcaaaattttactcttgccaatgccattggtagcacagagtttctgaacagaagtgccgtgccttttggctattgtttccaaagtatcgccttttttgattctataggtcataggagaagaagcttgtctgcctttcttccctttttttgcatagcgagaagaagtcttagaggcttttgcatagcgagaattgctccctcgtttgaatgtgtaaatgtctcggagcggcactccgttatcgaagtctataatggtactcggattgatgggaatacccatgaagcgggtctcgaagtgaagatgaggaccggtgcttcgacccgtgctgcctcctaatccgatcggttgtcctgctcgaacgatctgattctcgtctaccaattggcgactcatgtgtccgtacacagtctccagtccgttcggatggcgcaagactatgtagtagccatagccacgcgcttcatagctgcgtacacgaactttcccgtcaaaggctgctcgtatcgtatcgccacgattcactgaaagatcaataccatagtgcatccgtccgaaacgccgacggtagccaaattgagaggtgacctgcttatcttcgacgggcatcacgaacgaagagcaatcaatgtcataggagttcggaatttcgacatcggttcctgcacccacgaaagggtttacatactcgctccaagaatcttcaccatataaatctatggcagggtaattgagtgcttccatcgccagccgattttcatattcggcttttcttacctctttttcggaagaaatcttgttgcggaactccagccgatctgcaatcatgttgctaatgtaccgtacagagtccgagggctttgtacgttcggtctttgctttgctgttcacttggctattgcgcacatttctgacgggggtcacagccttcgtagcagaaatgaagcacagcgaacagcaaagcagaaggatcgattttttcgacatatttctgttcctgttttaaaataagattaagcagtcggctctacgttgaaaggtcgtggaaaacaacgctcccgagtctgcccttgaaaaaattcgctccaaagttgtaataaaaaatccgaataaccatgcatttggtaagttattttcgttctttgcacacattttgccttcgagtgcagggggtggtctgccttgtagatcaattcttttttttgcccaatatgtaatgtctcattggcaaaaaatgtacttcaaagacttctgatcaaaggaggattttatgatttgggaaagtgtaaaccgatctgagccactcggtaggactatcctccacggtttatttttaactttgttcggaaatagcctctgaaaaaacgaatggatattgtaagtatggccgataaagctcttgtagtggagatgagagatgtgacgctctgtcaggaggaaaacgtcatttttcaaaatttgaatctgaccctttccgccggagacttcgtctatctgataggctcagtgggatcggggaagagcactttgctgaaggctttgtatgctgaggtgcctatctctgccggttatgcccgcgtgatagattatgatctggcaaagttgaaacggaagcagttgccctatctgcgcaggaatttgggcattgtgtttcaggatttccagttgctgaacggacgtactgttgcggagaatttggatttcgttttgcgagctacggactggaaaaaccgagccgatcgcgagcagcgtatcgaggaggttttgacccgtgtgggaatgtctcggaaggcttataagagaccgcacgaactgtccggaggggagcaacaacgtgtgggtatagccagagctttgctggcgaagcctgcgttgatcctggccgacgaacccacaggcaacctcgattcggtgaccggattgcagatcgcttctctgctctacgaaatcagtaagcagggcactgcagtacttatgagcacgcacaacagcagcctgctgtcgcatctgccggcacggacattggccgttcgtaagaatggcgatgcctcctctttggtcgagcttgagtgcagatgctgtttcaagaaaaaatacggaaatagattagcacgataagatcaggaattgaaagttctcaaatttggcggtacgtctgtaggagatgctgaagcgtatccgcaagtgttgcccgactgattactttcggtaaaaggaagaaaaattatagtcctttcggctatggccggaacgaccaattcgcttgtcgaaatagcctcacaccttgtcaaacgcaatgtggcacaggccaaagaggtggtgcaggtgttgcgagagaaatatcatcgcgaaataaatgctctatacaaacgtccggataccttgagcgcagccaagaaggccgtcgactccctcctcgactctctgggtcatatgtgcgacgtggagggcttcacactcttcgaggaaaagcgtgtgttgatcctcggcgagctgatgagcacgaccatgatgcagatctatttgcaggagatgggtgcagtggtagccatgctgccggctttggagtatatgcgtaccgacaagaatgcagagccggacaaagactatatccggaagcatctcttgccgatgatagaggctcatccggatgaggatatgctattcctgacggagggttacatttgtcggaatgccttcggagagatcgacaatctccaacgtggcggcagcgactacacggcctctctgatcggagcagcactgaatgctgatgaaattcagatatggacggatatcgacggcatgcacaacaatgatcctcgtgtcgtagacgttacggcacccgttcgccgtctccattttgaagaagctgcggaactggcacacttcggagccaaaatcctccatccgacctgtatcaagccggccaaggagaagaatattccggtacgtttactcaatacgatggatcccgatgcacccgggacgctgatttcactggataccgaaaaggattgtatcaaggccgttgctgccaaggatggcattacggttatcaaggtaaagagcagcaacaaactcctttcatggcactttatgcgcaagctcttcgagatattcgagttctaccaggagcctgtggatatggtcgctacgagcgaagtgggtgtttccctgaccattgacaatgacaagaatctgcccgatattgttcgtgccttgtccgatattggagatgtgacggtcgataaggatatggtcatcatctgtatcgtaggcgatatggagtgggacaatgtgggcttcgaggctcgtatcatcaatgcgctgggta

SEQ ID NO: 1021 - DNA (genomic), 604 bp, PORYPHYROMONAS GINGIVALIS; double-stranded, circular
  misc_feature 1...604
  hypothetical: NO
  anti-sense: UNKNOWN
ccaaaaggaaaagagaaggtgatatgctttgatcatgcagaaagagggcgacagaggtcgcctgtgtttttttcctacttttggattgcataatcgataagcacaaactgcatatggtattcaactttctgatagtttccgatgaggtggaagatttccgccgagagatagcgatcgactccgaagctaccttcctcgacctccaaaatgcgattctggactcggtgggctattcgcacagcgagctaacgtcttttttcctctgcgatgaggactggcacaaggggcaggagattacgctgatggagatggacacggcctcggatgaggactcgtatgtgatggagaatacacgcttggaagagttcatcgaggacgaacaccaacgtctcgtcttcgaattcgacttgatgacggagcgttacttctttatcgaagtgatggatatagtaccgggcaaatcgctctcggagcctaagctccttacgtcggaaggattgcctccgcaacaaagctctctggacgatctgatggatccgactgccattccaaccaagcaagcccggggattggatctggaanaanacttcttcggcgacagcga

SEQ ID NO: 1022 - DNA (genomic), 1333 bp, PORYPHYROMONAS GINGIVALIS; double-stranded, circular
  misc_feature 1...1333
  hypothetical: NO
  anti-sense: UNKNOWN
tcgatgataatggaaagcctttctcccaattgtataaatcgctccacgacagcgggaagattgagatcaaacgccacgacccttacttcggccgttcgatcagctatagcttcgtctaaaagacggagcaaagcctctacagcatcgaaccccatccaagagagtgcagtgggagctttcgggtgagtaggtacaaagtcgattcccgacttcgagtccttcggcaacaatgcagccactcctcctccatccgaaaatctatcgacaaaagcctgagacgaaatgaatccgcgagtgaatgccacatcgagacaatccgggtaggtctcgcgatgcaatactacctccactcgctgctcctccccataactcaattcatcataatagttcataaaaacgggttttaccacatagacgaaagctccgtttttatctgcattgcgaggaaagtgtacccagcgaaacatttggaaaggagacaaaagggaggacttggccactttacacacagttccatcctgattgaggaaagaaagcctgttcttcaaagcatagtagcgatcgccatccggctctttgtactctatggaaaaaccgacaaaatcccgagggggacgcccctttttccaattcatggccaaaagaaccatgccgtctcctctatatactttcaaggaaaatacagccttttcgtttttaccggtcaaaataaaatcttctgaatactgtcccataatcatatttgttaatggtcaaatataatgaaagaatgttttgaaaaccaatatgaactgttgcatgggagtttcattgagctcttttgctgcagagcagattcttagtgtcttcgggaaaggtcaaacctccggtatatgggcacaccaagcaaacagaaattttcccaagtttccattagagaagtactcctttcctcgtcaaataggcgagaaataagaaacgattgtcagctgattcttgcttcctgcatgatgcaggacgcgattgtcagctgattcttgcttcctgcacgatgcaggacgcgattgtcagttgattcttgcttcctgcacgatgcaggacgcgattgtcagctgattcttgcttcctgcacgatgcaggacgcgattgtcagctgattcttgcttcctgcacgatgcaggacgcgattgtcagttgattcttgcttcctgcacgatgcaggacgcgattgtcagttgattcttgcttcctgcacgatgcaggacgcgattgtcagttgattcttgcttcctgcacgatgcaggacgcgattgtcagctgattcttgcttcctgcacgatgcaggacgcgattg

SEQ ID NO: 1023 - DNA (genomic), 828 bp, PORYPHYROMONAS GINGIVALIS; double-stranded, circular
  misc_feature 1...828
  hypothetical: NO
  anti-sense: UNKNOWN
gtcgatgcaagccttgtggagacgccacataaacccaacggaaccattacgattgaagtcgcagacgacagagaagacaatcggagcgaggcggaaaaagaggcagaggaggattatcaaaaacaggttgtccgccggcgtaaagggacggatgaagaagcccgttgggtgtacaaacaaaagcgttatcactacggatacaaaaagcattgttctgaccaatgttcaaggcattgttcaaaaggtgataacgactgcagcgaaccgcagtgacacgaaggagtttattccgctattgcagggtgcaaacatacctcaaggcacagccgtcttggcggacaaaggatatgcttgcggggaaaatcgttcctacctgcaaacccatcaccttcaagacggcatcatgcacaaggcacaacgcaacagggcattgaccgaggaagagaagcaaggaaacaaagcaatcagtccgatacggagcaccatcgaacgcacctttggcagtattcgccggtggtttcatggcggacgatgtcgataccggggacttgccaagacccatactcaaaacattcttgaaagcatcgcctttaatttatacagaaccccggggataattatgtcctcatctctaggataaggcataaccccccttgaggagctcgtgcaagtagctccgcaaggggggatttacaactactttcactccttactgccacccttttcactcgctccttttttgccaagaactcctcttccctccatctccttattttgcaaaggtctccataatggatactggttgcatcccgcccactgtcaactttt

SEQ ID NO: 1024 - DNA (genomic), 664 bp, PORYPHYROMONAS GINGIVALIS; double-stranded, circular
  misc_feature 1...664
  hypothetical: NO
  anti-sense: UNKNOWN
ggcgaagtgttgttcgagttcggatagggtctgttcgtttgtttggaggtctttgatgatctcgcctttttgcagtactacgatgcggctgctgacttcggtcacgtggttgaggtcgtggctggagataagcatggtggtaccgtattgggttgcatgttcgttgagcattttcttcagccgtatttgtgaggaaggatcgagagccgtgaacggttcgtcgaggatcaatatatcggggcgagagagcatggcagcggctatgcctatcttcttttgattccctttggaaaaatcccgaatgagtttgttcttgcccaaaacttcatcggcaaagaggggcgacatgtagtcgagaaaacgctctatctcctgcttgtcgaggtggtggagcttgccgatgaaatcgaaatactcctccggacgcaggaagccgatgaggaagctttcgtcgaggaaggctccgacacggcccttccaatcgtcactacccgctacggggatgtcgtcgatggagatgctaccgctatctgctttgatcagatcgaggacgaggcggaagagggtagtcttgccggcaccgttattgcctaccaaaccgaaggtttcgccgtggcttatggagagatggggaatatccagtacggtaaccccattgtatttt

SEQ ID NO: 1025 - DNA (genomic), 612 bp, PORYPHYROMONAS GINGIVALIS; double-stranded, circular
  misc_feature 1...612
  hypothetical: NO
  anti-sense: UNKNOWN
gatacgaaaaaactccgaagccaagtagttcaccgtttatcagagccggagcgtagccatcctattgctcggctctgcgaactgcttggcttcagccgtcaggccttttataaacgtcatctcaacgatttagctaggcatgaggaggatgtcctatgcagtagtatcatccaatattgttggcacttaagacaagcagagcacctacctcaagccggcttccgagagctcatggtgctttgtcagcaatacttcggccccaagttcacgcttgggcgcgatcgcttttgcgccctactcagacgccatggtatgatgctgcgcaaacggtctgtgcgccctcggacaaccaactctcggcataggctctacaagtatgaagacctgctcaatacagagcctaagtttgtgcctcaaagacctggggaactccttgtagcagacatcacctacgtggcttaccaagatgggtttgcctatctctccctactgaccgatgcctatagtcgctgtatcgtagggtattgcttacatcctaccctagaggttgaaggctgtttgaatgctctacatcaagcctttgctttctacgatcagcatcaaattgatacg

SEQ ID NO: 1026 - DNA (genomic), 2075 bp, PORYPHYROMONAS GINGIVALIS; double-stranded, circular
  misc_feature 1...2075
  hypothetical: NO
  anti-sense: UNKNOWN
caatcgcatagacatataagcctgatgatgttctgtccggaataagcacgaattaatgtgttagagatcctaattgtagaaggaagagaccaaggatacggagtacgacctttcaaatacgacaaggagagtcgaggtcatcgatctgctattgagtcctgatcttcccaaacaaggggggaaaatgaattttgaagacgcgaaattgggaaaatttccaaggtcgttctcgttttactttaattgtccataatgtactggtaattagcatgttgtaatgagcaccgtacgcctacgctggtctcctgcatcgtgcaggagtgcatcgtacgcctacgatcgtaagtgtttcgtaccggcttttcaacacttcttcgtattcctcggcataatcttcaatctcgtaccaaaaggtattgcctgagagcgtagggagaaaagggatggtttgcggtgaaaaaagatgccgtactccgacaagatttgttcggatggtttagaaaggtggagtgacgggtaagaagagtcggttagccgggcaatccgttgatgcggcagaaattttgaaggtcagttcgggaacaatttctgtgagattgagtgaagtgcaatagggaacacttctttccaatttattggcgcgcaggcgttcgtaatgatcgcgaccgttcaggtaggccatcagcttctcatgcgtattgtagttaccccagagttcttggaaaactgacgctccgtcttcgcaaatgacctcctctccaagccggacaatcgtagcagccaaagcaccggcgaacagacaatcctccgtactcatcctgttttgccagcccgaagccagtaccatgaccggcttctgcttggcgatacaatagcgagcgacagcttccagattgataaaagccccgataataacgtgcaaggctccggcaactatgtcggcagcgcgggtaccgttggtcgtcgatagtacgagctgtttcccctctaccgcctggcgagtgtactcttcgggagcattgccgaaatgagcgaaaggcaatcgcttcgttcctcgctcgcctcctacgaggaacccgttcccggcatagatttccgcctcctcaacggttgcaatcgggatgatgcctacggcaccgttcatcagtgccgttgtgatggtggtaccggcacggaagatatccacgataacaaccgtgtactcttcttgctccgtcttgtaatatggatagagtacaggagaaggacagagactgatctgcagcatctgctattcttagtatttctcgaggaatgtctccagagctttgatgaaaagctggttctgagcaggtcgctgcgtggtgattcggacgtaggattcatcgagaccacggaaattggaagcatcccgaatcagcatattatattcctccagcatatattttttcagttcggccgctgttcctttcttgaggcgaaggaggaagaacgtggtgcctgagggatgtacttctacaccatcgaggcgattcagggctgtgataaaatctaccgtattgcgttgccacttgcggatcggcagagtgaattgtgcaggatggataaggatgaatttggcagcctctatagccagtgcgtttaccgcccacggcgtactgaaagccgccacacgcttcataaaatctttattggctacgatatagccgatgcgaagccccggtatcccataggcatgactgaaagaatagaccatgacaaggtttttccgtcctttgatgtcggccggacgaatcacttcctcggtcgtaaacgatacataggactggtcgaggacgaatgtcgtgtcaggatgatcgttgagcagacgcaggatctctgtccgctgcagcagtctgccatcgggattgttcgggttacaaagccagcagaaatccatattggaaaaatcagcctcgcctatgtcctcattagaaggatagaagcagacttcgtgctcgtacatccgacaagcatcctcatattcggcaaaagaaggaatggctatgaggcttcggctccctctgaaagcctgtgctatttggtagaaggccgcc

SEQ ID NO: 1027 - DNA (genomic), 2192 bp, PORYPHYROMONAS GINGIVALIS; double-stranded, circular
  misc_feature 1...2192
  hypothetical: NO
  anti-sense: UNKNOWN
agtcggccaaggatagtttctattgctgtcggtaaaaaaatgaagattcttcaaaacatactgtaataatggaatttactttactaccatttatacgtggttaggctgttttccccttcgtaatgactcttgatagaacagtaatggctaagaaagggagattttatttcgaatttcctaaccgtccaaattttcccggacagcaatagatagtttcacagccatgaaactaaagtttcgtagtagtgaaactaaagtttctcgactgtgaaaataaagtttcttaaccgtgaaacttcttgaaagaaacggaaggaaaaatctcgcagacttctttatttgagcgatacggctccgggtttgcctgctttgatgtaggcgttcatggatttaatgtcgttcgggttgcagcggctacggtcgcagcggtacagctccgtgaagggatctgcatcgacgatcctctgcaaaaggtcgctttgggagggaatgcctttgatggcgaagtactgctcataggtgtattcgacgaaagctgtggtaggcccgatgccacggcggtcgaggagatagccgtcggccagctccaccggagtgcagaaaccatcgccacgacgaagatcggaaggggcaggacgtgccaccacatactttttgtcagccgagagggtgataggcacgagattgcgatagtcgcctcgcgtcttgtagatgatgatcggagccaatgccatagccggcgtcatgggtgctactccatcgtggccattgccctcctctcctccgatgaggataggtttcgggaaatcgttttggggcttctggttatgagtctgcgtcatttctgtgggactgttggtctgattcgttctgcatcccccactcaagaaaacgatagccatcaagagggagaaaaagattttacttctcattttctactcggtattagtgaagagaatcgaatttctcgtctgtaaattatcggaactaaggtaatggaaaatcctatacctttgtttttcctataaaaacagcacttctatcgacaacgatatgaaagaaagaatcaatcaactcctacaggaaatcggtcagtgtgtggctgccaccgtggaggaagccgaagctctgcgaatcaagtatctaagcaaaaagggcgaaatagcccgtctgttcgatgacttccggctggtaccgtccgaagagaaaaagcaaatcggacaaatgctcaatgagctgaaaaacaaggctcaggagcatatcaactcccttcgcgagcgggcacaggcaggctctgcacaagcttcggcagaaaccgacctgacacgaacatcatacccgacgagactcggaacacgccatccgatctccctggtgaagcaggagatctgcgagatctttgcccgcctcggcttcagtatcgccgacgggccggagatagaggacgactggcatgtattctcttcgatgaatttcgccgaagaccatcctgctcgtgatatgcaggacacattcttcatcgagcatcgccccgatgtcatccttcgcacgcatacgtccagtgtccaaagccgggtgatggaaaagacacaaccgccgattcgcgtcatttgccccgggcgtacctaccgaaacgaagctatctcctatcgggcgcattgtttctttcatcaggtggaagcactgtatgtggacaaggatgtttctttcgccgatttgcggcaggtgcttctttacttcgcacaggaaatgttcggagccgaaaccaaaatacgccttcgcccttcttatttcccctttaccgaaccgtctgccgagatggacatctcctgcaatatatgtgggggtaaaggttgcaacttctgcaagcatacgggatgggtggaaatactcggatgcggcatggtggatcccaacgtattggacaactgcggcatagacagcaagaaatacagcggctatgcgctcggtatgggtatcgaacgtatcaccaatcttaagtaccgagtcaaagaccttcgcttcttctcggagaacgacctcaacttcttggaacagttcaagagcgtgcactaaccctctgatcagtatcgaatgcgcaaggaagagcgatacaaagccgttatcgattggtttgccgagaatatgccggtggccgaaacggagctgcggtaccgggatcctttccagtt

SEQ ID NO: 1028 - DNA (genomic), 821 bp, PORYPHYROMONAS GINGIVALIS; double-stranded, circular
  misc_feature 1...821
  hypothetical: NO
  anti-sense: UNKNOWN
ggcaattatgctttattcttaaaggatgtccgtcacgattacgaccaagccgaggcatattacaagcgagcattagcggcggatccgaatcatgcgaataatcttgggaattatgccaatttcttatataatattcgttgcgattacgaccaagccgagacgtattacaagaaagcattagaggcagatccgaatcatgcgaatactcttgggaattatgccaatttcttatgtgatattcgtcacgattacgaccaagccgaggggtattacaagaaggcattagaggcagatccgaagaacgcaattactcttggcaattatgccttattcttaaatgatattcgtcacgcttacgaccaagccgaggcgtattacaagcgagcattagaggtagatccgaagagtgccaataagcttggcaattatgctcattttctcattacgtgtcggggggatttcaaacgtgctgatagcttgattcagcaagcattcgagaatgccgataatgacgaagagacgaaacccttgcaggccaagttatggttctacaggtatgcgcactattacgaggaatggggagccgaggcggaaaaagagctggcggctttgctgaatgtcggagcgaaatccatcggctggaacttggccccggatatagagctggctcggaaaaacaagcatccgcatatagagcaggtcgaagcctttgccaaggcattgacagagaaagcacagtaggcttttgaccgcattgccattcgctgttacttcgttggaacaaaatgcggtcatccttgttccatattgggttactcatg

SEQ ID NO: 1029 - DNA (genomic), 3182 bp, PORYPHYROMONAS GINGIVALIS; double-stranded, circular
  misc_feature 1...3182
  hypothetical: NO
  anti-sense: UNKNOWN
tgatggccaatagaacagctatcgtcatagcgcaccgactgaccacgatccgcaatgcggatattatatgcgtactgcatgaggggcgtatcgtggagcaaggacgccacgatgaactgtatgccctgggaggatactacacgaagctatgcgatatgaacgcagaatgagaaaatgatacttttgtgaagaaaagaaaaccgatggactacaagactcgcatcatatatgccttgttgaaaagcaggctgaaaaccatcgacacctatgcctctcgagctgaggaaatacaagaccgccagctcaggcgcatcctgtcgagtgcagcctacacatccaccggtatccgctacgggttcaatcgcataagctcgaaagagtgttttgctcgcaacgtacctgttcgcgattacgaatcgacacaagccgaaatagaacgaatgcttcgtggcgaaaaagacgtgctctgtccggggcgttgtacatggtttgccaaaagcagcggcaccaccaatagcaaaagcaagttcatccccgttccataccgccacctgcactattgccattatcaaggggggaaagactccctatcgttatacctacgcaatagacctgacagtcgtttcttcacgactaaagggttggtactgggtggcagtcacgcccctgtatccatgaatgccgatatacaagtcggcgacttgagtgccatccttgtcgagaatatgcctgtgctcggcaactgcatgcgcgtaccctcgaaagaaacgctcttgatggacgagtggacggagaagctcaaagccgtagttcgcgaagtggcgcatgtacgagtcggaagcttgtccggcgtaccgtcttggatccttgtcttgatcaaggatgtactcgcagctacaggccgagagactttgtcggatgtatggccggaattggaagtatttttccacggcggtatcagctttgctccctatcgagcgcagtatgagaagctgataccttcttcacggatgcagtatatggagacgtataatgcttcggaaggtttcttcggtattcaggatgatccgaaggatagcggtatgctgctgatgctcgattacggagtttactacgaattcatcccgatggaacatttcggccgccccgaagcggaagccatcccactcgaaggagtggaaaaagggcgcaattatgccatgattatcagtacgctcggaggactctaccgttatgtactgggcgataccgtacgattcacatcggtgaaaccatacaagatagtcatcaccggtcgcaccaagcactatatcaacgcattcggagaagagctgatggtagacaatagcgacaaggctttggcggcgacatgcaagcgatttggcgtgcaggcagtggactatacggtagcgccccactttttttcggaagagggcaaaggacggcacgactggctgatcgaatttgtctctgcaccggctgatccgaatgcgtttgccaaagcattggatgccgagttgcaaacgctcaattccgactacgaagccaagcggtatgcagacatgactctgctcccactctccctgacgatcgctcgctccggtctcttccacgattggcttacggagcagggcaagctgggaggacagcacaaagtgcctcgtctgagcaatacaccggaaataatgaggtctatcctcgaaatgaacagttaatcgcatcttcccgattattggcagggggagatgtttccgaacaaaagaatcaatgagtaaaaagaaagataaaagcaagactaaagcccgcaagggagacgctcctcgcatcaaccgtgccggccgtaggaacaagcgcatgaccaaggaggagatgcgcaatgccattttggacatattccaaagcaatcctcagagcgtgatgaactacaagcaggtaagccatctgatgggagtagaagctgcaccacaaaagctaatggtgaactccctgatggaagacatggctgtggatgacatcctgcatgagatagagcgcggacgctatcggtacaatgccttgggattgattgtcataggcacttttgagcgtcggttcaatggccgcaattcgtttattcccgaagggggcggaacgcccattttcattgccgaaagaaattcggcacatgccatggacggtgacaaagtgaaagtacaactctttgccaaacgtcgtggtcgcgcgccggaagccgccgtgatcgagatcatagaacagaagcaggccactttcgtcggcaagatccaaatcaatagagactttgctttccttgttacggaagatcgcaccttagcgaatgatattttcatccccaaggacaacctcggcaacgccaaaaacggcgataaggtaatagtccgaatactcgaatggccggagcaatccaagaatcccatcggagaggtacaagccgtattgggaccggccggagacaacgatgccgagatgaatgccattttggccgaattcggattgccttatgtctatccccaagaggtggaagaggcagccgaccgtttggatgggaagatcacagaagaagagcttgcccgaagagaagattttcggtcgatactcaccttcaccatcgacccgaaggatgccaaggacttcgatgatgccatatcgttccgtccgctggaggatgattgctatgaggtgggcgtacatatcgccgatgtctcgcactacgtaaccgagggcgggatcatagatcaggaagcatacaaccgtgccacaagtatctatctcgtggatcgcaccatcccgatgctccccgaacgcctctgcaacgacctttgttccctccgccccgacgaagaaaaatatgcctatagctgcatattccggatgaatgacgaagccaaagtattggattatcgcatctgccactccgtgatcaagagcgaccgccggttcgcttacgaagaggcacaagccgtgatcgagaccggcgaaggcgactgcaaggaggccattctcaaactcaacgagctggcacagcgacttcgcaaagaacgattccaaaacggagcgattgctttcgaaagaaaagaagttcgcttcgaaatagatgagaaaggtcgtcctctgggtgtaatcgtgaaggagagcaaggaagccgggggccgatcccttaaggt

SEQ ID NO: 1030 - DNA (genomic), 714 bp, PORYPHYROMONAS GINGIVALIS; double-stranded, circular
  misc_feature 1...714
  hypothetical: NO
  anti-sense: UNKNOWN
gatgaaaagctcttaagcttttgatcgagaagtaaaaactactactgattattctccaatatagtatcctctttttattcgatgaagtcgatttttatcttggtatcttggtaaaggggaggaagcttttcgtatggtttcgatccaaacggagtcggtcgaatcggttttgagcttacttcagcggaagcacctgtgtctgtggttgtcggaaagggggggcagatgagtcggactaatgttgtatttttggcgcatggaaagccgtttttaatataatagtatatggaagatagaagcaatctttttcgcctcagtgctttgatgggtttgatctttggtgcattctggtgtctgaagtacatctgcgtgatgctggcattcgggattcctttcttgctgctgctgtatattccgctcacttgtttcgtcccttttctggcttatatcctgacaaagcgttatcggaacgtgctaccgcaagaaatgcgtttcagctttatgcatggatggcagttttctactttgctctatctcttcgcggctgtattggtttccatccctcactactatttctatgccgagataatgccggcacacatgcccgatattatggcacagctggagcagtcctccgggcttatgacccaactcttcggtaccgatgagtggcgcgaggtgatggagcagatgctcaaggtgcgtcccatgtcg

SEQ ID NO: 1031 - DNA (genomic), 764 bp, PORYPHYROMONAS GINGIVALIS; double-stranded, circular
  misc_feature 1...764
  hypothetical: NO
  anti-sense: UNKNOWN
aaaacaatacgatcgaaatagcccgtcgtgataccctgacgaaggagacagtcggattggatggtatagaagaaacagtcgctaccctactcgatgatattcaaaaaaatatcttccaaaaggctctgaactatcgcaaagaacatacaatcacggtggacagctatgaagagttcaaagaaaagatcgaagatggcggatttatccttgctcactgggatggaacctccgaaacggaagaacgaatcaaggccgaaacgaaagccactattcgctgtatcccgctgaatggggacatgactccgggcaaatgtatggtgacgggcaagccctcgccccaacgtgtactcttcgcccgtgcctattgatccgtcaggccggacatcagtaaacaaagaatccactaaaaaacataaatacttatggcagaagaaatccaaatgtacgacgatgcggcatccgtggcttttattcgcaatttcatcccgcaggaattgaaagagaaaatgaccgatgacgacattgtttacatcgtcgatctgatttacgatttctacgagagtcgcggcttcatggatatggccgaggacagcgaggaaacagtggaggtggacgaagacgagcttgtggagtacgttgtcaagaatgctgcacgggatgaggtaggccacttctctgccgacgagatacgctttgtcgtgcaaggcgaactcgaatactgcgagagtatcaatctcttcgaagaggactgatactctacttgg

SEQ ID NO: 1032 - DNA (genomic), 772 bp, PORYPHYROMONAS GINGIVALIS; double-stranded, circular
  misc_feature 1...772
  hypothetical: NO
  anti-sense: UNKNOWN
gctacatttgccggcaaacaaagattctaaacgagcaataagcaactatatattaaactattacatcctatcaaccaactttcctaacgatccgaacgcatgaaatatactctcctacttcacaatctactctcacccatcccatccatttatttatatggcatcatcgcatttgaaaacagacaaacattgcacaaggaatagggactaatcattcctctccactcctgcaaatctataaggcacccgctcggttcggccacgaatcgagcgggtgtctcttttatatcagctctccaaacagccttttctgttctactatttatatacaaatcgaatacgatctatatacaaatggaaaatgatttatatataaatcgaaaacgatctgtatataaattgaaactgattaatatatacatcgccatcgaaactctttcaaagcagacctcaactcccaaaagtccgattcatgaacatttttaccttgaaaacctcttcctttcaatcgcttatttagaatgattccaaactcttcttcgttgttgaaaacttttctggtctgtattttcgtgaaatattttcagatgggatggtgattgtatccggcattatcgaatcaaaaaaacgaagtactgcttccggactacatatagctaacagactgcaaatgtcgaagatcagactgtaggcattccgctctgaatcgggtaaaaagctttgtctcagtgagtaaatccctacctttgtggcgtgcaaggcttttgctgca

SEQ ID NO: 1033 - DNA (genomic), 2250 bp, PORYPHYROMONAS GINGIVALIS; double-stranded, circular
  misc_feature 1...2250
  hypothetical: NO
  anti-sense: UNKNOWN
gccaaactccatacagcactgtaaacaaacactttacaccattacccctaaaaaggagctgtccaataattagacatcggcgtctaattattggacagtatatcctctgaaaggaaaggcctcctccgcgagggagaaagagcaaggaagcgttttatggccggttttcctcttccgctatataggcgattccctccttgagaagttcgatgcgctcgccgagaccatgacgctccagatcgagcacgctctgacgcacgcagtaatcgcccgctattccggccacgactatacgttcggccgagcgcaacgaatcgggtacttccgtctcgaaggcactgtaagcatcgcgctcctgcgtagtagccttctctatcatttcgacagggataccctcggccgaacaagcagccagagcctccgcaatgcatggttcgatagcggctcccaccgtatagcggacacaatgcgacggccactgtccgccctgtgccacgaagctgcaatgatcggccggatgctgatccatcgtcacgacgatagactttatctccttccgatgtgcagccatatattcagccaaagccttcatggctttcggtgcaccttcgacagccaacgaaccgcttacgaaatccacctgcggatccacgatcaaaagtaccatagctctatgcctttcttcttctttacggaggattagagctccaagtcgatgtcgtgcttctcgtgccaaggaagaccctgcttggctacctcttcgaggaacggatcgggatcgaactcctccacattgaagacaccgggcttgcgccagatacccttcatgaacatcatggctcctaccgtggcagggacacccgtcgtatagcttacaccctgcgttcccgtctctttgtaggcgacctcgtggctgcagttgttccagatataataggtacgctccttgccatcgcggataccgcggatgcgacagccgatactcgtctcgcccgtatagttctcaccgaggtcttccgggttgggcagcacggctttgaggaattggatggggacgatctccacgccgttgtacatgatcgggtcgatgcgcgtcataccgatattctgcatcacgcgaagatgagtcagatattcctgtccgaacgtcatccaaaaacgagcgcgcttgatcgtcgggaaattcttcacgagtgattccagttcctcatgatagaggagataggactcgcgctcaccgatactcggataggtcagcgtcttgtgtatttcctgcggttcggtctctatccaacggccgttctcccagtacttacccttctgagtgatctcacggatgttgatttcgggattgaagttcgtggcaaacgccttgtggtggtcgccaccattgcagtccacaatatcgagataatgaatctcatcgaaatgatgcttggccgcataagccgtatatacactcgtcacacccggatcgaagccgcaacccaggatagcagtcaggccggccttgcgaaaacgatcctgataagcccactgccaactgtattcatacttggcttcgtcgagaggctcgtagttggccgtatcgagatagttcaccccacagcgcagacaggcatccatgatcgtcagatcctgatagggaagtgctacgttgatcaccaattccggtttgaaactctcgaacagagccaccagttcttccacattgtcggcatcgacctgagcggtttggatccggacgtttttgatttcggacgcaatcttgtcgcacttgcttctcgtgcggctggctaacatgatctccgtgaatacatcggtgttcatagccaccttcttggccacaacggtacctacaccgccggccccgataatgaggactttacccatttttatatgattctttgtatgattattactcgcctgtagcgcaaagataaagagaacaggccaacaaatcggcaaaaagattccgcccccactcacccggcccccctaaagcgtagagatgcatctcatgcaggatcggcctacgcaccaaaatcttcttacatgccacgccataaaacgtggtgcgtaaacttttttgttttggttcgggaagtgaaaaattctcgcgccacaacgaaaaagttctcgcaccacttcgttcagaaaacacgcgccacaatcagatcatttgcggttcgtatttccgacaaaactgatccggactaaaaggaagttaagtagtcatgttacacggct

SEQ ID NO: 1034 - DNA (genomic), 2018 bp, PORYPHYROMONAS GINGIVALIS; double-stranded, circular
  misc_feature 1...2018
  hypothetical: NO
  anti-sense: UNKNOWN
ggcaaggaagtcgcccgtttcttgattgctcagatgtccgttcggccccgatactcgctctttcagaaactccggatagggtccgcttagcagcatctcacagtcatagttggcttccataacgagataatcggctttggaagcatagtgagaaatggtgtcggtgatgtgtccgacatcggtgcacagcgtgaagctgaagcccggagccgtgatatggtaccctacgttttctgtggcatcgtgagggatgggaaaggccgttatatcgaatccggccagacgaaatgtttcttcctgaaggatattgcgccgtgaaaggagtgggaggtgatccatgtatctactgctgttgataccgttatgtactctttccgtagcaaatacgggcaggtggaatttttctcccaggcagccgatagttcgaatgtggtcggcatggtcatgtgtgaccaatacacctacgacattaccttcgatggggagctgatgatctttgagggctttggaaatgcttcttaatggaatgcctgcatcgataagcagtgcctgattgccattggagagatagtagcagttgccactactgccgctggcgatactcatgaatttgatcatcttgctttccgttctcctttgctctttgccccgactgtccgactgaaaaagatcagcatcggcatttgttgttttcgtacccttcgcccacgcttatttctccttttagagagcgtttcatctctgcttttacacgctccggtgtatagccacgcccgaacagatacatgagcttgatgatggcacactccgtcgtactgtcataaccgctgataagtccgatgttttcgagttgatgccccgtttcgtatcgatgcatatccacatagcccgatacgcattgggtaacattgacgatgacgattccacgctgaacggccttctccagagcattcaggaaccacggctccatgggggcattgccactaccgtatgtctccatgactacacccttcagtgaggggatgccgagaatgctctccactacttctcgtgtaatgccggggaatattttcaggatcacaacgtttctgtccatttccgtctggacactgagggcggcatcggcccctcggtctgctatcagagcatcctcgtatcgaatgtcgataccggcataggccaagggtgaaaagttgtatgaagcaaaggcgtcgaactggtctgcactgactttcgatgtacgattgccacgcatcagatagttgtcgaagaaaatacaaacttccggtacgcgggcatagccgttttgtttggctgcagcaatttcgatagcggtgatgaggttttctttgccatccgtacgaagggtaccgataggcagctgtgaccctgtcaagattacgggtttctgcagatcatccagcataaagcttagagcagaggccgtgtaggccatcgtatcagtgccgtgtaggatgacaaaaccgtcgtaggcccggtaattctcccgaatggtgtcggccagccttacccacaaatccggagagatagcggccgagtcgatgggaggatcaaactggatggagtcgattttgaaaccgaaatttttcagttccggcacattggtttccagatatttgaagtcgaaagcttctaatactttcgtctccggattctcaatcataccaattgtcccccccgtatatatgaggagaatcgcagaacgtcctgaagcagatttagtttgcattatgtggtgagctaaacaaaacggtggcggttttttccttccggcttccaagatcgtacagccatcggactatggctttggatacggccggtgcgcaaagataataaaagctcgttcagagcatgctttacggccagagcaatcgtttttgaagtgttaacacacatataaacctgatgatgctccatccaaaataagcttagcacgatattgtctgagagcgtagagaggaaaacgatcaggagtaaaagtcaagaggataactctt

SEQ ID NO: 1035 - DNA (genomic), 2661 bp, PORYPHYROMONAS GINGIVALIS; double-stranded, circular
  misc_feature 1...2661
  hypothetical: NO
  anti-sense: UNKNOWN
ttctttttttcactcatctcttgcagacgactcataaacgcttgctttggtcgaagagatgacgcttctcttcggcagtcaatgatgcatatcccgatatacgaattttatcgaggatctcatcgatggaagtctttgtttctcgtattttgggatccgttccactctttttagcagccggattggtcgttcttcttactcgaaagcgaggcttcgagcatacttttcttcggccggagagcgagctgaaaaagtcggtcatgcgatcgagcagtcgctgaaaccaaaccgtgatgtccttgcctcgggccaatgaaagggcaaacaagactccgaaagccgctcctccgatatgtgccacgtgaccaccgaagttatcccccgtcaatagcaatacatccaatacaaaaaggatgagagccaatgtcgtcagcttgatccgacctatgaataacagattcactcgctcccagcgagcataaaaagccactccgaagacaatggccatcacgctggcagaagctccgatcagagggaaatgagacaaacccaatgaaaaggcgtcagcgaacaagactgccaatacatagagcaatcctccggccagtccgccaagcagatagacactgaccagccttctgggattctgatagcgcaggaaaagctgtccgaaccaatagagccacagcatattgaagaaaagatgccatagatccgagtgcagccatatgtacgtgaatagcgtccatggatgtctcgaaaaggtatataaatcgggggccaaccaaagccaccgctccacgatatacggatcggcatccaaaagagacagaaaggcatgcaaaagccaaacgaacaaggagatcaagaccgtgaataccatcaaacgagtattcatatcagccaatctcaggcgttggcgcagttctctaattgtaaggtccatcgatctctcctttcctgcgccagaggagaatgagtataatacctcctatcataccacccaaatgagcaaagtgagcgatgttgctaccacctgccatcggtgcaacaccaaggaacagctctacaaggccgtatataataacaaaccacttggctttgatgggaatggggataaagaaaaggtagatctcaccattggggaagagcatcccgaaggccaatagcaacccgaatacggctccggaggcaccgaccgtcgttggcaaattgaggaaagcactcttgagcatctccgtaccctccggaaagcgaacaaactcggccggactgttcacgatgggcatcagatccacagcccatacgatctgctgtgccaatgcagccgtaagaccacaaataacatagaagatgaggaaacgcttcgccccccaaaactgctctatcagccgtccgaacatccatagggaaaacatattgaagaagagatgcgagaggccatcgtgtaagaacatataggaaacgaactgtatgggattgaaactgtctgcctgaaaataatgcagccccatggtatcgttcagatcgatattgaatcgtgcctcaagtacgtaagtcgcgaacaggaatatcgcattgatgatgatcaggttctgcgttacgggtggagcaaactgataattcctttctctaaagctattcatattatggattgttcttgttttctatttcaataccaagtattcgtgatgggacgattgctctgctgatanttcagatcctgcaagagtgaactcttcnccgatatgacgaaannataggacttgtatgctcctatagggatgaaactggccgagatagcccagcagtgcatgtcgcgagtgacgttgcaggtaagcgatgttattttcttcaagtcgaaattgtagttcgcattgaatccgaagctccagttcggtgtaggctggatattgccgcgaaagctcagattctgcgttacccggtagtagtgctccatcttattgacattgtacctattgtagtcggtagcaatattccaactatagtcgaaggacaggctccatgggatcgaatatgcgaagtaaccatcctgatccactgctccgccctgacggttgcgctcgaggagcgaccccccactttcattttgcggtcttcctccctcaagtatatcggcagcatcgtctccttcatgaggagtagcccctgtgtttttcttttcatctctccgctcctttttgccactgaaaagagctatcaatccgctgagcgactctttgttgagcgtatagctgaaagaagtacccgtactgatcaggcgtgccaatcccttgccgttaaaaatgcgcaggtcgttgctcttatagggaatgatcttcccatcttctccctcataatacttcgtcaaatagggatcgaacagaccggacaagcgcaaggtaaagctcttggagaggcgaagtgccagcgaagccgagatattgctccatcggatcgaatcggcaaacatattataggatgtagaccatgtgaactgatctatcaggctgatcttcttgatccctgtcgaatccgatttggatttgatcttggcctctaagttgttgtcaaaagagaaattgacagatcctgcattgcccatggagggagcaccgaatatctgctcgaaataaggagagtagagcagcgtatgcagct

SEQ ID NO: 1036 - DNA (genomic), 1029 bp, PORYPHYROMONAS GINGIVALIS; double-stranded, circular
  misc_feature 1...1029
  hypothetical: NO
  anti-sense: UNKNOWN
ctgatgatagcaggcaaaaagatcgaggatgtgcgtatcgtagtgaacggtgcaggagcatcggctttctcctgcaccaaactgtacgaatccttcggtgccagaagagaaaacatcctgatgctcgacagcaaaggggtgatcacggcagatcggacggatctgaccgaacagaaacgctactttgccaccgaacgtaccgatgtgcacacgctggccgaggccattgccggtgcagacgtcttcgtcggtctgtcccgacccaatgtgctcacgcaggatatggtgcggacgatggctcccaatcccattgtatttgctctggccaatcccaatccggagattacttatgagcaagctactgccgctcgtgaggatattatcatggctacggggcgttcggattatcccaaccagatcaacaatgtgatcggtttcccttatatattccgtggagctttggacgttagtgccaaggctatcaatgaggaaatgaaacgggctgctacgatggctatcgcggatttggcgcgagagactgtccccgacgaagtactgcgagcctatggcaatactcagttgcacttcgggaaggactactttattcccaagccggtggatcctcgtctgatcgttcgcgtatctactgccgtagcacgtgcggcagtcgagagcggagtggctgagcatcctattgcggattgggctgcttatgaggccgaattgttgggacgggtgggactgatgagccaccttacgcgtcgtcttcatgaatctgccaagctcaatcctcatcgcgtgatctatgcagcctgcgagaatccttcggtgctgaaagctgccgtatcggcacgtgcacatggaatagcccgaccgatcatgttgggggatgagaagcaaattcgggattttgccgcagagttggatttatctttggagggtatcgaaatcgttaattacccgcttccgatgaaagaaaaggcttcgccgtcattcattatgcccgtgtctttgccgaacagaactggc

SEQ ID NO: 1037 - DNA (genomic), 2318 bp, PORYPHYROMONAS GINGIVALIS; double-stranded, circular
  misc_feature 1...2318
  hypothetical: NO
  anti-sense: UNKNOWN
gggagcttcgattcgattcatcagataccagcgtttcgatcgtttgtgctgttcgtattggatgacttcggcattgccatgcacctgtatctggcgtacaaggctgtcctgcatataggctctgatatgtctgccggccagctggtcatacatgacggaatctatccgccgaacggcaagagccttggtaagcacatcgacatagtccagactgtcgttgcggaatttgaaccggatcgtatcgccgctcaactgggagtcttcattccacataatggggttgtcataaaggtagagcagagaatcgcgagagtcgtactgcatagagtcggcaatggcttggacatcagttcgataaacccgtacatgtctgtacccgcgtgctatccgcctatcctcggggacgcgacgctgcgtgatcatctcaagcgtgtcggctgctgcccacaaggtgtcgggtttggaaaagtcgatcatataagatcgttgggtggcaaaagcatagtccttcttctcatcgtaataaccatactccccataaagagaagaacggttcaccgtatcggtgaggatcatattgccgaaggcttcgccaaaaccggtacgacggtcgtaaaagatcgagtcccccgtcaattgcttggccccgttggaggaataaacgatggagcgatccagcaaaatgcctacatcggtgttcgaatcgtacactcctcgcgtagaaacgatatagccggagtccgatctcatctccgtaggccccaatatgtgactgatcttggtatctgtattataatgaagttcttccgtgtccatggtatagtccttattttccaaatggacattatctcggaagatggcatcggatgtggtgggagaatattctccatagctggaagtcagcgtattgagagagtcgactatgctaccaccttcgaaatagtagcccaggttcatgacccggtcataatccaaactatccgtaaagagagtagccgaacgattttccagtcgcacttcatggcgaagacgagcgtatttgatgtttccatcataatggagatagcgggcgaacatggatacggtgtcgccctgctgcatggaaacttggccgaatgcttcgaaagtgttctcttcctgattaagatgagcgctgtcgcagcgcatcacagctccttcatgcttgatcacgacattgccaagcagacgctgtacatcggggttgtagagtctgtcgtaacggagttcatcggcatgttcgaggatgacatgcgttttccccttactccctttgggagggggaccttggagagaggcaagggcagaaaaagagagagtgacgatcagaattatcgcccccagttgtcggctaccgagccgagattctcgtttttctccctttctcatctatttgtactcgagacagaaagaaactctctctccaaagagattttctttccaccccgaattattgtctgtcttcaagccagcccggatagcggaactgacagttgcggtaggcaggttcgatgtggatataagtttctttttgcttcttccttatccatgcatcgacaactccttctttctttttgtttagggctaaggccttgatcgtttggaaatcggagttcatgttggctcggtgtccttcgatcagatttttgatcttcacgatgacaacctcctcattacctttgtccgttttgagaataaaaggcttggaaacttcaccgggcttcatattgtagacaactcggctgatgtcttgtggcaactcttcgtacttgaagcgggaggaactataaaaatcgctctgctggagcttattgaccataagtccctgattgttgcgcgtatcgttatcttcagagtattgggcaacggctttttcaaaggtcagcttatttccttttatcagggagtacaagctatccagcttgtttgtagtttccgtcaaggcagcatcagatactttgggtttgagtacgatctgtcggaaattgatcacatcgcctcgtttctctatgagctgaacgatatgatagccgtcgtcggttttaatgatcggggaaacacgcttcgtatcagtaagtgaaaaaaccacgcgagcaaactccgcatccagcgaagccttgctgacaaagccgtattcgccaccctgtaaagcagtcttggagtcttcggagtacaaacgggccagcgtagtgaaatcgcgtcgtccttcattgatctcatccgagaattcgcgcaatctcttcttgatagcatccgtttcatgcagagagattaccggcttgatggcaagtaattgtacc

SEQ ID NO: 1038 - DNA (genomic), 1819 bp, PORYPHYROMONAS GINGIVALIS; double-stranded, circular
  misc_feature 1...1819
  hypothetical: NO
  anti-sense: UNKNOWN
ggcaagcccatttctttgagctggagggtcaggtaaagattgcgctccagattacaggtgtctactacattcagcaccagatcgggacgggtttcctcgcttagatattggcgaatatacagttcttcaggactgtatggagaaagagagtaggtgccgggcaggtcgataatctctatcttgtagtccccgtgccggaagagaccttctttcgcttctaccgtcacaccgctatagttccccacatgttcatgggcaccgctggcgcggttgaatatggaggtcttaccgcagttgggatttcctatcagggcaacgcgtattacatgtccgttcggcttgacttcgatctctatttccgattttgtcttcgctgaaatatcctctgtcggatttgttggaatggattcgttcgaatcgggatttgcggattgctctcctatgtcattgcttgccggtgaagaagtcgcattcgaggatatgagctccacttctattttggctgcatcctctctccgtaaagagacattgtagtccatgatgcgataatagaccggatcccgcaatggggcacactggacgacggtaatcgtcttgccgtgcacaaatcccatttctaaaatccgtttgcggaataccccgcgaccttctactcgtacgattactgcttgatcgcccgtatgtaattctgataatctcatgatagcgcaaaaatactaactaaaccaatgaataaacgagaaatacaatttattattaaagagactgttgcacaataaccctctccccctctcatattgatcaagacagacacaagcattgatttgacgaagaaaggagagcttcatgcaatctctctgcaaacctcaagtaatctgaaaaacacttaagaatcagctctgcggcaaaagacttcaatgaaagtcctataaaatagttgcaaacagctgatagttagcgcattgatgggagcagaatcagctgacaatcgcgtcctgcatcgtgcagggagcaagaatcagttgacaatcgcgtcctgcatcgtgcaggaagcaagaatcagctgacaatcgcgtcctgcattgtgcaggaagcaagaatcagctgacaatcgcgtcctgcattgtgcaggaagcaagaatcagctgacaatcgcgtcctgcatcgtgcaggaagcaagaatcagctgacaatcgcgtcctgcatcgtgcaggaagcaagaatcagttgacaatcgcgtcctgcatcgtgcagggagcaagaatcagctgacaatcgcgtcctgcatcgtgcagggagcaagaatcagttgacaatcgcgtcctgcatcgtgcaggaagcaagaatcagttgacaatcgcgtcctgcatcgtgcaggaagcaagaaacagccgacaatcgcgtcctgcatcgtgcaggaagcaagaatcagttgacaatcgcgtcctgcatcgtgcaggaagcaagaatcagttgacaatcgcgtcctgcatcgtgcaggaagcaagaatcagttgacaatcgcgtcctgcatcgtgcaggaagcaagaatcagttgacaatcgcgtcctgcatcgtgcaggaagcaagaatcagctgacaatcgcgtcctgcatcatgcagggagcaagaaacagccgacaatcattccttatttctcgcctatcggcacaagcattgatttgacgaggaaaggaatacttctctgatggaaacttggtgaaatttctatttgctcggtgcccatataccggaggtttgacctttcccgaagacactaagaatctgctctgcagcaaaagagttcaatgaaaatccc

SEQ ID NO: 1039 - DNA (genomic), 1182 bp, PORYPHYROMONAS GINGIVALIS; double-stranded, circular
  misc_feature 1...1182
  hypothetical: NO
  anti-sense: UNKNOWN
tcatcttgatcagaatattctcctcctcaatgccttccgtccggtccgacagggaaaagagaggtaagagatgattattgttggttcttattattgtaattcttggggttgaagtctttccaaatcttcagcagcttttctgtagcttcttgcagactgccttggaactcgccgccggcagcattcttgtgtccgccgccaccgaagttctcggcaagggtgttcaccggatagttgcctgtggagcggaatgagagcttgatctgatttttgtcctctcgcaggaaacatacagcctctatccctgcaatatcgaggggcagattggccagaccatcggtatcacccgtccggttgtggaatcgtaccagctcctctgctgacagcgtgaagtatgctacgcccatttccggcagcaaagtcattttctcgtacagcacataaccctgcatcctcatcttgccttccgaattttgctgaaaggtattgcggatgatcgtgtctttgtccgcaccggctcgcataagatctgctacgagcagataaagatccggatcggaagagctgtaggaaaatacgcccgtatccgtcagtatccctgtcatcaaagccgtggccgcatcttgggtcaggtaggactccatgcctatggccttggccaaacgcaagaccaactccgaagtagaagacaggggggggtagctgaagctgagagtgaagatatctgccggatagagatgatgatcgataagcactttgggggctgacgaactctccaatgcgctttgcagtcctgctacccgatgtggagcattgaaatccatgcagaagaccagatcggcttcagccaatgccttctccgcctccgaagnatgagtctcgtgcactattactttgtttgctcccggaatgcagtacaggtattggggaatatcatcaggtacgattacactgatgtgggacntgcctttttctctcagcatggcagcaaaaccgatactgcttcctaccgagtcgccgtccggagccgtatgcgagatcagagcgatgcgctctgcctcctctaccattttacgcaaagctgttgccggagccggatcgatttttattcctgccataacttttcctctttagctttttcttcgctttgttttcagagattcgtaggggatcctctagagt

SEQ ID NO: 1040 - DNA (genomic), 614 bp, PORYPHYROMONAS GINGIVALIS; double-stranded, circular
  misc_feature 1...614
  hypothetical: NO
  anti-sense: UNKNOWN
ctcggtacccttaacagctcctttcgtatgtgtgtatttagcccaatcgtatagggcaaggcaaagggtaatggtcgtagagtctaggagcttgacgggttgcttaaaacgaaacttacgcccttgccccataccctgctgtccgaaataatctagcaaggcataatagcacgctcgaaagaagtctgaggtacggtgctcgttctgataagataaattggacttagagggtgctgtgcatatgcctaagtggttgaggttacctgtggctgagcgtaagccattactaatctcgcgtaaggagatacagcttgagaattggctgaaaatcatgctcactaagtgttgccaccctgtgaagtgtttgctatgttngtttacttgaaactctgtagagagcttcttaatcaacggacgaggnaacaggnggataacttgggcgaataggcttatatttgtactcatcagagttttctgtggaatatacccaaggtaagatgatttaccttaggtggctctgataatagacgaaaggagaggtgctgtgaagtacctctcctaatcttttaccaaaatagcttttaggacactaatggtcgcgagtatgaatttta

SEQ ID NO: 1041 - DNA (genomic), 879 bp, PORYPHYROMONAS GINGIVALIS; double-stranded, circular
  misc_feature 1...879
  hypothetical: NO
  anti-sense: UNKNOWN
tctcctgacatttggcacggtgtgcatcgtcggcatcgggacgctccgtagccaagcgcatgttgtggattttgagcttcagtatcgagaggcgatcgattgcccatgccggactttcggtgttgatcgtagcatcggcagtaccttcacatccttgtatgtatcgagaaaatagctgtctatcaactccaccagatcggttctgtcttgattggatttgtcgatacggcgtttgattaccagcgcatcagccggatcgatgttgggatcacgtataatatcttcgagatgccactgggcattatcgatccaattcttcaaaaacaaataatgctcgatcgtttgaggccgatatggattgttgcacggtgcgtctacgctgtcggtgacgttataggcctgaatagcctcgccgaaaatcctattgcacaacttgctgatagtcataattattattgccgcttaatttgtcaaaattataatgctatgcggacaaagatatataaaaaaccgattggcgaactctgagaattaagtcctccaatcggttttgtaaattgctaaaaagcaacaataattttaatgagtcttttttgactctcttttttattgcttatcagttgccttttcgtgcttcttggcgtgcgggcaatttcctgcttcagctttgcctttgccttcgcaagatttgtggccgtgcttgctcttgcactcgcctttttctgacttgtggcagtcactttttttgcagtctttggatttgtccttgctacaatcttttgcgttggcatccttggccttatccttacagcagtctttggcatctttagccttgtctttgcaactctcgccagctttcttggcatcacaagctttgtc

SEQ ID NO: 1042 - DNA (genomic), 1244 bp, PORYPHYROMONAS GINGIVALIS; double-stranded, circular
  misc_feature 1...1244
  hypothetical: NO
  anti-sense: UNKNOWN
tgctcaccgatcccacttcggacagagcacgccggacgggaagaatcctccctcaagagccaaacgttgcccgcatcgaggaaaacggctgcgtggagatccccgaaaagcttgcctctatattccacgttggcttcgagtttgaattcgcccacctgatccaaataggaatactgattgtcggaatccggattgaaccgtccggggccgatgctacggacggtgaaagctctgatactattggcaccgcctacatagaactgctcgctatagggtgccactcgcatattgccatagctatatatcacgcctgtcccgaaacgggttgccagtgactgattgcggtctatggtataggaatagcgcagttctcccgtggctttgatgaactgagagaaggggacgccgacgaaattcttggtgtcgctgtacttcttgccggctgccagatagatcagattcaggagattgcctgcctcggatagtccgaattgcatccaaagatgatgaggacttttctctgaaacggatttgttgaacgtatagatataccccatttgagcaaggaactgactctgaaggctgagcagcaggggcggattgttcgccgtaatggcctggaaagtttctgtctgatgccccaggaggttgtagttgagcttgagcgggaaaatagcatgccggtgttccttggagggctgaaattcgtaggtggtcgaaaagccgaaagagtacatgctaaagtagtgtgccctgttcagcgcggtggcagaagcctgaaaagtcgtagtcgtggggtagtaatagtatttatccagcagaccgggaaatacaatcgagggaaacgagaggttcacggccgtattcatgttgtacgaatttatatcgatcagccgattgctgctattttcgggacgattgccggtctcccactcatacgatccaccgatattccaagaaagattttctcctccgccgaatacattgcgccgagcaagagcaaaattcagtccgggaccgatgaagtcattgcttttgctcgtgaacaaggtctctaatgatgcatcccaaggtttgtcgagggtggttagcagtcgcacatccaaaaggccggaaatggaatcgcgttgcaaaaaattgagatcgataacggagaaggctcccaaacgagccaaggatttgcgtgtcgtctcatcgtctttctgccgatacagattgccggagaaagaaacgaaagcgtttgg

SEQ ID NO: 1043 - DNA (genomic), 3901 bp, PORYPHYROMONAS GINGIVALIS; double-stranded, circular
  misc_feature 1...3901
  hypothetical: NO
  anti-sense: UNKNOWN
tactgtttgtggcaaggttaattgttataatcaagacaaggagccgaagcgaaagcgagtcttaaaagggcgcccatttagtcacgagcagtagacgcgaaaccaagtgatctacccttggtcaggttgaaggttaggtaacactaactggaggaccgaatcggtaagcgttgaaaagctttcgaatgaactgagggtaggggtgaaaggctaatcaaacttggagatagctcgtactccccgaaatgcatttaggtgcagcctgttggatgttatcatgaggtagagcgactgattggatgcgagggtttcaccgcctatcaagtccagataaactccgaatgcatgataattgaccgatggagtgagggcatgggtgctaaggtccatgtccgagaggagaagaatccggaccaccggctaaggtcccgaaataattgctaagttgtaaaaacgaagtcaagatgcagagacagctaggatgttggcttggaagcagccattcatttaaagagtgcgtaacagctcactagtcgaggattttggcatggataatacacgggcataagcaatttaccgaagccgtgggatatagtaatatatcggtaggggagcattccagcgacgtagaagggaaaagggcgactttttctggagtttctggaaaagcaaatgtaggtataagtaacgataaagggggcgagaacccccctcgccgaaagaccaaggtttcctgatcaacgctaatcggatcagggttagtcggggcctaaggataagccgaatggcgattccgatggaagaaccggttaatattccggtactgatacagagagcgatgtggtgacggagaagtgacagtccggccgtctgacggaataggcggttaaagggtgtagatgttgatcggggtaggcaaatccgccctgagagtcgaacctgacagtacccggagtacaagtacgaagggataaggacgtaaaccggctcccaagaaaacccgctaagcatatttctgtgttacccgtaccgtaaaccgacacaggtggttgggttgagtatactaaggcgctcgagagattcgcggttaaggaactaggcaaaatggtcctgtaacttcgggagaaaggacgcctgtctccggacaggccgcagaaaccaggcccaggcgactgtttaacaaaaacacaaggctatgcaaaaaagcaatttgaggtatatagtctgacacctgcccggtgctggaaggttaagaggaggagtcatcgtcaagagaagctctgaattgaagccccagtaaacggcggccgtaactataacggtcctaaggtagcgaaattccttgtcgggtaagttccgacctgcacgaatggtgtaacgatctgggcactgtctcaaccgcgatctcggtgaaattgtagtatcggtgaagatgccgattacccgcaacgggacgaaaagaccccgtgaacctttactatagctttacattgtatttgggcatcagatgtgtaggataggccggaggcagagaagcgggtacgccagtattcgtggagtcgatgttgaaatacggcccttttgatgtttggatactaactcgcggcgtgcgaggacagtgtatggtgggtagtttgactggggtggtcgcctccaaaagcgtaacggaggcttctaaaggtaccctcaggccgattggtaaccggtcgcagagtgtaatggcacaagggtgcttgactgggagacaaacaagtcgcacaggtaggaaactagagcatagtgatccggtggttccgcatggaagggccatcgctcaaaggataaaaggtactccggggataacaggctgatcactcccaagagctcatatcgacggagtggtttggcacctcgatgtcggctcgtcacatcctggggctggagaaggtcccaagggttgggctgttcgcccattaaagtggcacgcgagctgggttcagaacgtcgtgagacagttcggtctctatctgttgtgggcgcaggaaatttgcgagggtctgacactagtacgagaggaccgtgttggacagacccctggtttaccggttgtaccgccaggtgcaccgcgggtatccacgtctggtaaggataagtgctgaaagcatctaagcacgaagccggcctcaagataagatttccataaatagggtggttaaagactatgaccttgataggctgcaggtgtatgattggtaacaattaagccgagcagtactaatagcccgaaacttttgtgcatcccgaaggatgcggtataggttggtttgttgccgcaaagcttgaggaattatttgttggcctttcgatatgtcgattgccttttcgaagtattcaggtggttataacgttggggatccacctcttcccattccgaacagagaagttaagcccaacggtgccgatggtactgcgtcacagtgggagagtaggacgccgccgttttttaagaagcgtgagagagagggggggataggatctccaccctcctccccggaaaaaaaggtgaaggagagagtctcgaatccgaggctctctccttttttattttctctctctccaaaaatcattttgcttttctctctattcctctttctccttttccttccttcctttcctcccccttgctgcgcgttattcctctaacagatcgtacgccaactatctcattgttcggtaggtaccataggtagccgcggacggatggatagcccatcgagacgagcagccggatataattctccatctgtgcatgatgaactttgcgaactgctccgaatttatagtctacgatgtctgtgtgatcgtcgtagagaatgatccgatcgggacgacgctgttccccttccgggaggagaatatcctgttcattaagaactcgtccgctaccatcgaaccaacgagacaatcgactgtccgaagtgacaacagataggcgatcgaccaattcgatcgcctcatctctcgtgacgattcctcccgacacataacgctcaagagcaggctcgatgtccttggcgagaacgatgtcggcaaggattctgtgcattacatgtccgtggtaaagcggtttgtgcctgcgataaaattcactgccttcaggccggatagccaagcggtcggctacggccgagagacttcctttgggcagggtaaaaggtaagccagaagaggggtgatctgtcgttttttgtctcgcggatatgaccggacttccccagcagtacatatcggactctgtcttattctcgtccaaggaagcaagagctaaatgtataagatctcccacggtagagagcgattcgggcttttgggaaggatgtaaccacagatgcatctcgtccttcgctcgtgtcgtagccacataaagaagattgaggttgtcaaggagaatatcggctctttctcggaaataatctgtggcaaacattgtttgtgccatctccttcttatatctgatcggcactacgggcaggatattgaaaggactgcgggcaggatcgatcttgcaccagaggatgtgtcgatgtgctgcttcgtcgtccagattccagtccaagaaaggaataagaacaacgcggaagcctagacctttcgccttgtgaatggtcattagcgtgacggcctgactgttgggagcggaggaaatacggcttttggcatgccccgtttcgtcccaccattgcaggaaagagtgcagatcggcagatcgttcgtgaccgaaatcattgattaaatccagccaagcaattagatagggcatctctctttcaggtaggtatgaatggaaaaaagagaccaatccttctgccaattcgtataaggagcgacgacgaaggttggcaaattctgcaagctctgcggc

SEQ ID NO: 1044 - DNA (genomic), 1478 bp, PORYPHYROMONAS GINGIVALIS; double-stranded, circular
  misc_feature 1...1478
  hypothetical: NO
  anti-sense: UNKNOWN
gagggctatttacctgcttctattgcagtcaatcagacaacagctcacgagcaggacgtggatttgtaggaaggctctgagagacaaacaggcaacttactttgcaaactttcggagccgacaagcttcagcgagccggacgtatcacacggcatgattcccatagtccagcatccctgccggaatatgatgtgtgactacgcttccggctccaatgacggctccccctctccgatgtttacacccggcaggctgtaggtttgaaccagcctcgtattataacgtcagttcgacgtaagaaaacgccaatgaataattcttttcctgatcagaggctaatgccctaaaattctcagacaaataggggtaccctgcttctgcttggatcgaaccaacattgaaattcggattgcttttttgaccgaatgttacagtccgtacagaaagatgggctataccatagggcacatggaggtactccgtaggggatgacgagctatcccgtacagctcttcgagctacgctgtagagctcagcgaggtacgccctacagcgtagcgagccgagccgtagagttccgctccgggagctgtagaggtggccgagccgagccctagagcccggcgcgccgagccctacagcgtagctcgaagagccgtagagcgcagctcggtacgctctacggcgtagcccgagtcgctgtaggcgtagctcgaccccctttcggagtatgttccgaacggctataaaacaatgcggattcgatccaagaaaaacatgcaatatgctgtttgtcaacgtatttcatttctcggttgagagatttcagcttcgggagacttcgacatccgatgagacgtcaaactttttccctttcattttctgatcggttatagttaatatcccaacaaaggattgatcgacaaatacttatgagagtcggcaccataacgcttatatcgaactcactttataagaataacgcgaagcaagggggaggaaagcaaatggccgattatcctttgctgtgtccgactgaggatgaaaagagaaaaggaaaggaagatgaagggaaacagaagggaggaaaggaaggaaaaggagaaagcatatagaggaatagagagaaaagcaaaatgatttttggagagagagaaaataaaaaaggagagagcctcggattcgagactctctccttcacctttttttccggggaggagggtggagatcctatccccccctctctctcacgcttcttaaaaaacggcggcgtcctactctcccactgtgacgcagtaccatcggcaccgttgggcttaacttctctgttcggaatgggaagaggtggatccccaacgttataaccacctgaatacttcgaaaaggcaatcgacatatcgaaaggccaacaaataattcctcaagctttgcggcaacaaaccaacctataccgcatccttngggatgcacaaaagttt

SEQ ID NO: 1045 - DNA (genomic), 2384 bp, PORYPHYROMONAS GINGIVALIS; double-stranded, circular
  misc_feature 1...2384
  hypothetical: NO
  anti-sense: UNKNOWN
cggcagtaccttctgtagaaaagcttgccgaagatcctatggtactcttcgcctcttcggttttcgacgaataccgcaaactctacaacgaacttcgtccctatgacgatcctattctaagggcacaacgcacctacattgcaggtctcttggaaatggatggcgatcaggatcaattcccggatgctaacctgacacttcgtttcacctatggtcaagtgaagggctattcaccccgtgacaatgtttactacggacatcaaaccacattggatggtgtgatggaaaaagaagatcccgataattgggaatttgtagtcgatcccaagctgaaagccgtatacgagcgtaaagacttcgggcgttatgccgatcgcagcggtcgcatgcctgtagccttttgcgccaccacacatacaaccggcggcaactcaggcagtccggtcatgaatgccaacggcgaactgatcggtctcaacttcgatcgtaactgggagggagtcggtggcgacatccagtatctggccgactaccagcgcagcatcattgtggatattcgctacgtcctgcttgtgatagacaaagtaggcggttgccaacgcctgttggatgaaatgaatatcgttccctaaagctataggaggtgtgtcgaacgtccggcacgcctcttatctattataaatcatatcgggacagatctccttccggtaaattcggagatcggccggtgtgcgaccggagaggggcagccccacgaaagaaaacattgacaacaaaaacgacaagaagatgagattgaacctaagctccatgatttctctatccgaaataccggagcgatactaccgtccgcagaatacttacgaagagaccctgctacgtcgcttcgagaatataccgaccaatatataccgcaccaacgacgaagcagcagaagtcattgccaacgaaatagccaaggatatacgggagtcgcaagcacaacacaaatactacaccctggctctgtccggaggcaattcgccggtcatcgtctacgacaaactgatacaaaaacatcgcgaggaaggactcagcttccgcaacgtgattgccttcaccgtattcgaatactatccaccggtcagcgagaacttaggctgtctggccaaattgcgcaaggactttctcgaccatatcgacatcctgccggaaaacattatggcacccgatgtatatgcttcggaagaaaaactactgcaagcctgtcaggactacgaatccaaaatagacagcttgggtggcatcagacacatgctcctcggcatcggctcggccggcagtatcgccttcaacagcccggggacgcaccccaacacatacacacgactcgtcgtactcggccatacggagcacaacgatgctctgacgatattcagctcccacgacaccatccccccatcggctatcagtatgggactggctaccatccaaaaagctcacaaggtgaccctgctggcatggggagagagtaaggcagaggtaatagcccaagctatcgaaggaaagatttgcgaggcttctccggcttcgtccctgcaattgcatcgcaatgcctccatcgtgctggatctatcggcatcgtcttgtctcacaaggatcagtcgtccttggctggtgacgagctgtatctggaacaaacagctcatacgcagggctgtggtatggctgtgcggactgaccggcaagcccatcctgaagctgacgaacaaggactatacggagaacggattgggcgaattgctggccaaatacggctcggcctacgaggtgaacatcaagctcttcaacgacatccagcacaccatcaccggctggccgggcggaaaacccaatgccgatgacagcagcaggcctgagagggcactaccctatcccaagagggtggttatcttcagtccccaccccgatgacgatgtcatttcgatgggaggaacattccacaaattggtcaatcagggccacgatgtacatgtagcctaccagacctccggcaatatagccgtgggggatgaagaagtgattcgatatgtgtcgtacctcagaaatgtatgccgccaatacggtcatgagagcagccccattctggccaaagcggaagaggtgcggcactatctcatgcacaaaaagatagaaggggatcccgagcaggaggatatcaggtttatgaaaggaaccatacgacgcgaagaagcccggacggcatgcagatacttgggattgccggaggatcatgttcatttcctcgatctgcctttctatgagacgggattgatcaggaaaaatcctttgggagaggaagacgtgcgcatcatcatggctctattggaagagatacagccgca

SEQ ID NO: 1046 - DNA (genomic), 852 bp, PORYPHYROMONAS GINGIVALIS; double-stranded, circular
  misc_feature 1...852
  hypothetical: NO
  anti-sense: UNKNOWN
gagttgctcccccgtgtcgtgcaaaacaatctgacggcggtgctcaaagacgaccggcgcagctatcgtttcttttccttcggcaagtatatggcccgggatgaaaatatgttgctgagcgatccggcaacgggggccttgcaaatggatccggacgtgcggatgcacgatttggccacacgaaacggcctcgaatccgattttcgtttcggccgcgtggcactgcattcgaccacgacgatgggctatcgaggggagcagatcgactaccgctcctcgcttccgcaacccgatgtggaggacttcggcggcacttacggttaccatgccggccactgggagctgagcgagaaaccctcgttttcctatcgtttcggccgcacctatcatcgtctcgacctgcctgtcgcgtggcatctgttcactttgaacgataaatccgcagcagaacggcggcaggagagccgagccgccttttcgccggctctctcgctgcactgggagccgggggcggcatggaagctgaatgtctccgtccgccacggtcattcttttggcggtttggagggatttcgctccggctatacgcgcagggactaccgcacctacctgcttccttcgggcttcatgagcgagaggcgatattcgggggcaaacttttcggtcgactatggcgacgtgctgcacctgttctattttcatctgaaagccggatattcgcgcagtcgctccaacgaattgccccacttcgactacacggcggaacataatatcatccgttacgagcgctattggcacgatcttaacgcttttttcgccgatatgcgtctgagcaagtttttcttcccgtca

SEQ ID NO: 1047 - DNA (genomic), 3640 bp, PORYPHYROMONAS GINGIVALIS; double-stranded, circular
  misc_feature 1...3640
  hypothetical: NO
  anti-sense: UNKNOWN
caaaaccaataatacagacatggcattatcaagaatcatggagtgcgtgcccaacttctcggaaggccgcgacaaagagaaaatcgaaaagatagtaaaccccttccgcacgcgcgaaggcgtcaagctgctgaactatagcaacgatgaggatcacaaccgtctcgtcgtgaccgtagtgggcgaacccgagccccttcgggaggcagtgctcgaagccgttggcatagccgtagagctgatcgacctgaccaaacacacgggtcagcacccccgtatgggcgcagtggacgtgatcccctttatccccatcaagaatgtgactgccgaagacgccgacaccctcgccaaggaggtaggccgcacgataggcgagaagtacggcgtgcccgtattcctctatgagaaatcggctaccgctccccaccgtgaaaacctggccaagatccgcaaaggcgagttcgaaggcatggcagagaagatacacgaagccgactggcatcccgacttcggcccggccgatcgtcacccgacagccggcaccgtggcagtcggcgcccgcatgccgctcgtcgcttacaacgtgaacctcaatacgaacgacctctccatcgcggacgccatcgccaagaaggtacgcttcctcggcggcggtctgcgcttctgcaaggccatgggcgtagagcttaccgaccgcggcatcgtgcaggtgtccatgaacctgacggacttcaccaagacggctgtctatcgcgctcatgagatggtacgcatggaagccgcccgatacggcgtatccgtcgtaggcagcgaagtgatcggactcgtacccatgcaggcactgatcgactgtgccgaatactacctcggcatcgaaaacttctccatggatcagatcctcgaatcacggatcatggagtaaacgtcagcatgttttttgtttgaaggatagagataccacccgccaccctcttccgggtggcgtggtggggttctatcggcaagcttccttaccgacacacatgcctaacaccccccacacaatgaacctctacatcaagaatatcgcccagctcgtcacctgccaaggctccgaagccaaacacggccgcgaagccatggggcagatacacaccatcgaaggccctgccgcagtagttatccgcgacggcatcatcgccttcgccggccgcatggcggacgtagccccgtccatgaccgaaggctgccgggagctggacgccacgggacgctgcgtactgccgggctttgtggacagccacacccatctcgtcttcggcggctacagggaagatgagttccaatggcggctcgccggcgacagctacatgagtatcatggagcgcggcggagggatcgccagcaccatgcgcgctactcgttccgaatcggaagacgagctgaaagcatcggcccgacggcacctctccaatatgatgaagatgggcgtcaccaccgtagaggccaagagcggatacgggatgaacctcgagacggagctgaagcagctgcgcgtagtgcgcgacctgcaggacgagcagcccctcgacctctactccaccttcatgggagcacatgacactgcgcccgaatacaaaggacgtcccaccgaattcatcgagtacctctgccgcgaagtactgcccgaagtcgtacgacagaatttggccgagtgctgcgacatcttcaccgagaagggcgtattcgatcacgaacagacccgacgcatgctcacggccgccaaggaagcagggctctccgtcaagatgcatgcagacgagatcgtgccattcggcggagctgagctggctgccgaactgggatgcctctcggcagatcatctgcttcggatatccgacgcgggaattaaggccctggccgaaagcaacaccgtggccactctgctaccgtgtaccgccttcagcctccgtgccgactacgctccggcccgtaagatgatcgacgccggctgtgccgttgcactggggagcgacctcaatccgggcagttgcttctcggcttccgtccccctcatgtttgcccttgccaccctctacatgggcatgaccgtcgaagaagccatcacagccctcacgatcaacggggctgcagccataggaagagccgatacgatcggcagcatcgagccgggcaagaagggcgacctcgtcgtactccaatacccatcgtacaaattcctctcctatcacttcggtatgaacctcgtggagcataccgtcaaaggaggcagggtcgtctacaccaactcataatcctcacggcaaagaccggagcggagcaccgaacgaagctccgctccggccttgtcttttccccaccaaaaaccaccgcatacatcattataaatggagacaagatctcaacacaagaaactgacgttcaggcgtcatctcttcgaagccctcggcttcatcattctcttcttcgccatattcggctatgtagggcatgtcatgggtctgcccaatatgctcaatacgattatgcagacctcctaccacctcctgctcgagaccgtattctatattatgggtatcacggtactgagcggagccttgggcagtctgctcgtggagttccatgtcgtggatatgctcgagcgtatcctcaggcccctgatgaagcccctttacaacctgccgggcgtgtcggcactcggaggcatcctcaccttccttagcgacaatcccgccatcatctctctggcacaggatcgcaagttctgctcctacttcaagaaatatcagctcgtcagcctcaccaacttcggtacggctttcggcatgggtatggtcgttatcatcttcatggcaggacagggctacggcagcggtgccatcatcggcctcttcggagccatcatcggcagtatcgtcagcactcgtctgatgcagcggagcacgctccgccgctatccggaaatggacagtccggtcaatgtggaggagatgcagcacgaggaaacgaaagagcataaggagaaccttttcctgcgtatgctcaatgccgtactggacggcggcaagacgggtgtagacctcggtatcgccatcatccccggcgtactcatcatcagtacggccgttatgatgctcaccaacggacctgccggacccgacggcaccttcgccggcaaggcatacgaaggcgtcggcctgctgccggcccttgccgacaaggtggacttcctcttccgctggctcttcggcttcaccgattcccgcctcatcgccttcccgatcaccgcgctcggagcagtcggtgcagccctcggactggtacccaacttctcggcgcaaggtatcctggacggcaatgcagtagccgttttcaccgccatgggtatgtgctggagcggcttcctcagtacgcacacggccatgctcgacagtctcaagtaccgccgcctcatcacacaggcgatcggagcacatgcgatcggcggactcgtcgccggcatattcgcccattggctcttttgtcctcatctcactcatttgattcgatacccgaccaacgtatgaacaaatcgctattatcattggcatgcctcatcctgtgcggtatgccggccatcgcccaacagacaggaccggcc

SEQ ID NO: 1048 - DNA (genomic), 2040 bp, PORYPHYROMONAS GINGIVALIS; double-stranded, circular
  misc_feature 1...2040
  hypothetical: NO
  anti-sense: UNKNOWN
agccaagaaacaacagagggagaaagagcggccggacttaaaaagaaaaggccttctaaatctgcattttgttcgcagaatctaaaaggcctgttcaaaagttaatacgatcaagaaaaacggaggatgtccgtaatctcttccgaaagagataggcttatcgcctgcgaccgatcagattgagaaactcttcgcgagtggtcgattcctcaaaagctcctgtaaagtcactggtcgtagtcagagagttttgcttctccactccacgcatctgcatgcacatgtgctgtgcttcgataacgacgatcaccccgagagggttcagcgtattctggatgcactccttgatttgtgtagtcagccgttcctgtacctgaagacgacgggcaaatacatcgaccactcggggcaacttgctcagtccggttatataccgattggggatatagcccacatgggccttaccgaagaacggcaacatgtggtgctcacacatcgaaaagaaatcgatgtccttgacgatgaccatttgctgatagtcttcttcgaacatcgctgcgcgaaggatggcttcaggatcctcgttatatcctttggtcagaaactgcatggccttagccacacgtagcggagttttgagcagcccttcacgcttagggtcttcgccgagcaacgacagtacttgggcgtaatgctgttgcaagcggctgcaggcttcttctttttctatttctgtcatttgtcagtatccttgacgaatcttatctcgtacgacataaatctcccgtgcatatgaagggaatgattttttgagttgttgcttagcttcttcagcttcctcacgagagctgaaatctcctacaaggagccgccaaaaaggtgctcggtaagtcagatagcaatgcatctcgggatgcagctgcgttatttgagctgctcgtcgattggcttctcgcttagaggcagccatattgccattgtatacctgtatccgatagccttggatcaaacggatattgctctcgccctcgatcaaaccggccaaacgtccggataccttgcccacggcagctttacggatgcaggctgatagatggtgatgatgccttctccttcgtgctccgcactgagagcttcgaagatgctgatcggggctttgctatgagccgatgtggaaacctgagcttccgatgacgaatggcaaaccaacgaaagcaataggagactaaaaagaaaatcggtttcatctcgttcgtttctccttttgaaataaaactcgcccgaaagggtgtgaaacaataagcaatctcagaatgcttcgatgataggcaagaatttgtctaccgagagagaagcccctccgataagcccaccatctacatccgcacggctaaagagttctttggcattggctgcattgcaactgcctccatagagaatggaacaaccgttcgcaacctcttttccatatttagcggctatactcttacgaatatgtgcatgcatctcttgagcttggtctgccgtagccgtcttacccgtaccgatggcccacacaggctcgtaagcaaggatcaatttggcaaagtcggtctgatccaaagtaaacagggcttcttccacctgacgagcgactacctcgaagtgcttgcctgcttcgcgctcttccaagacttcgccaacacagaaaatgggggtcaagccattggacaaagccaacttcaccttctccatcaggattggggatgtttcatgatagtaagcacggcgttcgctatgtcctataatcacataccgagcaccggtactggctaccatagcagcagagacctctccggtatatgcacccgactccttatcggcacagttttcagctgcaactccgatacgtgtggtatcgatggctgccgcaatacttgccaaatggatgaatggggttccgataatcacgtcacagttgatcgtacgccctttcaaagctgcgtccaactcctttgccaatgcaagcccctcttggagggttttgttcattttccagtt

SEQ ID NO: 1049 - DNA (genomic), 805 bp, PORYPHYROMONAS GINGIVALIS; double-stranded, circular
  misc_feature 1...805
  hypothetical: NO
  anti-sense: UNKNOWN
ttcaggcgaaggttatggagactgccgaacccggcatgtcgtgtgccgatctttataaacgctctgtagagatggccgaggaagcaggggctgccgataaattcatggggacgaagcagcaagctaaatttgtgggacatggcataggactccagattaatgaaatgcctgtactaatggctcgcagtaaagagatactgacgcccgggatggtgatagcctttgaacccaaatttgttcttcccggtattggggccgtaggtaatgagaatagttttctggttacggaatccggtgtagagaaactaacggtctgttccgaagagctgatagatctattggctgtagcgaaacaataaacattgaatccaatcatctaacagattaacaaacaatgaaacgaatcaaacaaactcttagtacgattcttctttttattatcgtactctctccggctctatatgccggtcagccacgggaggtcaagccagttcggaacgtgattctgatgattcccgatggtacctctctttcggctgtttctctcgctcgctggtatcagcgatacctgaatcccgaccgccggcatttggctatagatccatatatatgtggtactgttctgacctattcgtccgatgccccgattggagactctgcacctactacatcgtgctatatgacaggtatgccatccaatacgggttttgtgtcgacttatcctgtcagttcgggtgatgcagatctgattccggtggataaggctcgtgcttattctcctttggctacttttctggaggcggct

SEQ ID NO: 1050 - DNA (genomic), 650 bp, PORYPHYROMONAS GINGIVALIS; double-stranded, circular
  misc_feature 1...650
  hypothetical: NO
  anti-sense: UNKNOWN
accttatggatggccagtccgtcagaattaaagaccaaagcaaactatgagtatatacgaatcggctgtaaaaaagccggtcacaaccatattgatattcgtggcgatagctattttcgggctattctcactgagtcgtctttccatcgacttgtatcccaagattgagacgagcaatatcatggtcgtgacctcctatgccggagccagtgcatcggacatagagaacaacgttacgaaggtcttggagaatacgcttaacggggttagcaatctcaagcacattacttcgaagagtcgggagaatgcttccgtcattacgctccaattcaatgaaggtgtggacatcgaagtggctaccaatgatgtgcgcgacaagctcgatgccgtctccaacttcctgcccgatgatgtgaacaaaccgatgatcttcaagttcggtactgacgatattcctatcaccatgctatccgtgcaggccaaagagagtacgatggccctgtcgaagatcctcgaagacaaggtcacgaatgctctggcacgccttgatggcgtaggtgcggtgagcattatgggtactgtgaagcgggaaatacaagtgtattgcgatccggccaaactggaagcatacaacctgaccgtagaagctg

SEQ ID NO: 1051 - DNA (genomic), 831 bp, PORYPHYROMONAS GINGIVALIS; double-stranded, circular
  misc_feature 1...831
  hypothetical: NO
  anti-sense: UNKNOWN
ccatactggctgaagattgcgatcgctgcacatcatcgtaagctaagcatgaagcatgaagaacgatggctaagcagtgatgaagatatttgctctgtgtggaaggatatcagaagattgtcaaattatttctttgatgatcggaatagcgttctgtccgatattgcaatcaagcaatatgaatttgcaggaccacgaagcttacttcaattagcggatcacagagcgagtgcaaaggaagagtcaaaatgcatcccggatccgattgctttttcttatacctttcctgaaaagtgggaaaaaagacctgttcaaaagctggtagaaaagcattggagagacgaacttcttttagtacgagcacccactggtgctggaaaaacggatgcagcactcttgtgggcttctcatcaaatcaaacacagaaaagcagaccgcttgattattgctatgcccactcgttttacaacaaatgcactagctctaagcgtatcttcgaccctttcttctacaggcctgtatcattccagtgcatggacacagaatttcagtagcaaaatagacaacggggaaatagctttagagcaggcaagatactatcataaccaagctcgcttactacagacccctataacggtatgcaccatagatcatctcctctcttcattgactctttgtgacgaggaacatcagaccattacttttgcactggcaaatgcatgtctcggtattgatgaggcagatttctatgatcaatttacacaagctaatatattagtattactagagggtctaaaatatggaaagtgccgatattgctgatgagtgcct

SEQ ID NO: 1052 - DNA (genomic), 616 bp, PORYPHYROMONAS GINGIVALIS; double-stranded, circular
  misc_feature 1...616
  hypothetical: NO
  anti-sense: UNKNOWN
cggtttttgattagtcttctgtagccttggccaagaatataatagtcgtatatcttttggcttcaggcagatttttgggtgatagcagacctttatcggccggtcttgctatcaccctcaatttgtggctttttctcggtttttgtctttattcggaaaaaaacctttatgtgtttagtagagtcttctgtagataccttcgatctcatctacagtaagctctacgtagttgttggcgagcaatctttgctgtgtcttaagcactgattccgcaaagcctcttacctcttcgtccttcatgccgtattcgtgcaaaggtttcttggtaagaaggcatccgagaagttcatccagcttcggatatacgtattcgggctggcagttcagtatcttggagagcttccagttgagttcgactatatagccgaaaggattcttcttttggtatactttgaatacctctgtgaagaactgatagtttgcttctccatgcggcacgtgatagtcgcctcccaacgggtaggatagtgcgtggacggctctactccgcatttccgaagctataccggcatagttgctggccatgatcattctccagctttcgagcggattcagg

SEQ ID NO: 1053 - DNA (genomic), 3879 bp, PORYPHYROMONAS GINGIVALIS; double-stranded, circular
  misc_feature 1...3879
  hypothetical: NO
  anti-sense: UNKNOWN
cgcggatcccgggaattctcgatcctgcgggcagctgagaggtaaatacctttacgcctaagagattgtacacttcaagggcaagacgcttgccattgctgttgtactgaagggtgcaagtattaccgctctggataagagctatacgccctagcccgatattagtcaaaccggttccaccgcctttgtacttgaagttaatgttcactgtagccaattctgtgccgggagcaccactctcggggaagcagctaaaagtgaaagctcccgtatgcccttcattggacacgggaaatttataatgcaaagagacgtactctccttcaccatcaagagcctccacaatgggggatacagatacattcggccccatacactgaccaaagcacaaagcaaagtgtccatcaccgatcatttcttgcttggtaatcttgccgattacattgataggtgtagcggattggttgataaccattccttcaaatttcatctcttccgtaccatcttctgttgtgaaagcagtaatgtccacagtggcattattttccaagataacatctcccaccttgatcacaacttgtgcattgagagcagcaatgaaacctgccaacaatgcgatgctgataaagattttcctcatatttctttttgtttttttattcattcattatttgccatcggattgcggattgatctttacatgcacaacgtcatacacttcgaacgtctgcacatcgtatacaaaagccacaatcgaataattctcggctacgaaggacatacccgagagcggttcaacggcgtaagtatacaaataatctttgagattcacaaattcttcgccccaaataccattaacggctccacgcaacacgtgattgtgctcgtaattctcgactgtcgtattgccatccacctgcggagcgatcagcttatcctccaacagatacacctgaaccatggacttcgggagtgtattcccctccagtattttaccctttacagtcaccttgatcttttgggtatcggtgtattcggccacggcaaagatattgatcttcgccttttgctccatctgctcggcaataggcacgtcccacgttttgtagctcttatcataaacgtaggaagagccgaactttttgcgcgaaaccatcagcgcagggagaggggtattattggcgaacttgctataatatgcgtctccggcttctgtacggaaaagaggtggcacgagagatccagggccggcatgtataccgacaacagtcaatctcttaccgtattgctccttgagagccgccagtttgcgatgacctttcggacagttgagacatttttggccggtaaattcttcagccaaaacatatttttctgtgtgcgtctgcgtaatgtcgatctccgaaggattgtcatccggattatcgggtgtcacattggtcggagccggcaagagggtttgatccttgtcgattatatcgcaacttgcaacagcgaagaccattacaagactcgtgagcgagagaaatagctttttcatcagtgttttcttcgtttaattacagattggtgctataagaaagagtagaatccctgagtctcagggaccacacgacatacacctcccgagcagttcatccctgcacgggttttgcctgcagagaaagctactcgatgtgctccgtgagtataggtgacagaccccatgacataatgtttcttggtctctccgatattatactgctccgagagggaaagcatcagagaaggcaggatagagagctcggcattgccgtagatccagtcaccctgatcctgcttcgtgtgcaaatattgcagttcggtacggagggctaccttattactcagcttatacttaccatcatagacgaagatattggcatagatcttctcaggcttctctccggctgcaccgtgcagtaccttgttattgtagatctgattcaagtaggtgagcgtaaagttgaatcctgggcttacctttttagtaatctccacatctatatccgaataatagaggtcgcccatgccgaagaaagaaacggtgtagccatccgttccgatcagttcgtcgggattctctttgagcatctttttgtccagaccacgcacatgcgaaacgttgatacgcaagccggtaccgtagcgtccaccgngagctgtccggcgagcnaagttgtaacgcagttcaccttggaaagcccattctccctgaggctgagtagcataggggtagatggccgccagcgtataagtgtgagcttgggtaaaagccggcatatagttgatcataagcggtgtgagctgggcacttcgcttgctgcggaaagcaaagttctcacaacgtttggcctgcaacaggatactcatcccttttttggagtatgaggcagagaggagtgcagcctgtccgtcgtggtagatatagtcattgtctgccgagggatcgttgtatttgtatccatactctgcgtagagggcgagacctcctttttgaaagttggtgcgcaggcccataatcgggacattgagcggcaggttgagtcgcttgcgatcttcgcctacacccacaaatatatcttcgtctgcttcgtgtttggaaacgaacgatcccccgatagccaaatgatagtcattgtcgcgcatggcactgctccaacgctctacattcagctccagatcagaacccagtaggtagcctcggccggaattgaataccttgcccgtgcggtcgaagtagttacgctgctgtcctgcaatacccttgacacgcactccatcaaaaggagtgagtactatacgtccgccgcgaaccgcgttgtctataccgaggttgcgctcttcataggtgcggaataccataccgctaccgaactgatcgtagaagtctcccatagtcagctccgcccaatgatagcttcccttcacatacatgtgaggaacgccacgccccatctcgggttcatgtccgggcaggggcttatagagatcctcgaaacgggcaccaaactccagataattgttcttgattatacccatgatataggagttgccgaaccaggtgttcttggacttttgggcagtagaaagcagcatatcgctctgaatactgaaattggcatgcataggttgccatttatccggagcatcatccctattcaaagaggaggattgcatgcttgtaaggatacgattgtctttcgattccgtgctgtccgttggtaccgcaaaagccacagaggctaccggcatcagagcaagcagtaagatcaacttgcggatcataatacttttagtcttttctatatgataataaattaaccacttgtgggagctgctattacttcaccagctctcgaacttttttgattagctcggcttctccgccttctgtataaccagtatgggttgtatactatcttgccgttgccgtcgacaataaatacagccggaatgagggaaaacgttcatgggcacgtttgaaatcaccgttgctgtcgagcagcacttcgtattcccagccgttgccgtcagccagaggtttcaccttctgtgcattttgcccctcatcgatagatacagctataagccttacgcccgtctcgtcctgccaatctgcatatacctcctgaatggctttcagctcgcgcaaacagggcttgcagttcgtagcaaaaaagctgatgatcatcggctttccggcattctccaacttgttggtctgtaccgtttttccttcgatatttttcaaactaacggccggaagctgagcatatgtattcagactgaacaacagcccaatcagggcaataaagaagcatttcatcttttacttttgattaaaattattttggatgc

SEQ ID NO: 1054 - DNA (genomic), 609 bp, PORYPHYROMONAS GINGIVALIS; double-stranded, circular
  misc_feature 1...609
  hypothetical: NO
  anti-sense: UNKNOWN
ccttacaggcaagaaagcccgtatcaaagagcgtcgcgtagctctttcttctaaagactaatttgcttataacggttattaggggggcttatagagatatatcctcattccctaagtattatgcagagagggtgtatcgaaaattgatttcggtacaccctcttctctttaacccagattggtcattagagattaacgtatagaatcaaggcattacttattactttcaaggaaaaagaattatgtccgaataagcatgtatttcacatcacccgattggtgagatgaaattgggatgctgatgtgatttctataagaaggtaagtggcagttattaagcagattacaaagaaaaatctctaatgacggccattagtttttttgaatgcaatccactttattccattaacataggctcttataaacttgaaggattaagcctaatttaggctcaccaattgttggttgagacccgggtaacacctctgcttgcaacaacttcccagtctttcttcaagacacgctcaataagcttgaggagaaaaaagtcggactggtcgtgcgataggtgcttctgnaacaacagggtatcgaatccttacaaagcaa

SEQ ID NO: 1055 - DNA (genomic), 976 bp, PORYPHYROMONAS GINGIVALIS; double-stranded, circular
  misc_feature 1...976
  hypothetical: NO
  anti-sense: UNKNOWN
ccatcattggttacagtcccgcttttagggttaggcatcaatccgcgagggcctaaaacacgtcccaatgcaccgattttacccataatggcaggcatggtgatgatgacgtctatgtcagtcccaaccagcctttattttttctatgtattcgtcaagacctacatagtcagcaccagcttctttagcttcagcttctttatcaggagagcacaatgccagaacgcggatctgctttccagttccgtgcggaagcgttacaacgccacgcaccatctggttagcctttcgggggtctacacccaagcgcacatcaatatccacagatgcatcaaaattggtcgtggtgatctctttcaccaaggccgatgcctccgatattgtgtatgctttcccgggttcaatcttgctaaaggctaacttctgtttttttgttagtttgctcattttgagtaagattaaattatttattccgggaagtcccctttaatcgcgatacccatgcttcgagcagtaccggctaccattttcatggcagctttgatatcgaagcaattcaaatcgacaagcttatcttctgcgatcgtacgtacttgctcccatgtgatttctgctaccttcttacgattaggttctgcagaaccactcttctgtttgctagcttcaaggagttgaatagcaacaggaggagtttttacgataaaatcaaaagacttatcggcatagtacgtaattactacaggcaatactttgccggctttgtcttgggttctggcattaaattgcttgcaaaactcatgatgttgatgccctttgcaccaagtgcaggcccaacgggggtgagggattagctgcaccaccttttattgcaatttgatttgtccagcaacttcttagccattggtctaaaataaaaattcagacacacactatatcaatgcgagagagaaagatccgaacacaacctcatctttct

SEQ ID NO: 1056 - DNA (genomic), 947 bp, PORYPHYROMONAS GINGIVALIS; double-stranded, circular
  misc_feature 1...947
  hypothetical: NO
  anti-sense: UNKNOWN
aggatcccccgatgataagtgtgggacgctcgccctctcccttggcttcggtcagggccttgcgaatttcatccgcatcgttacctgcaatctctattaccttccaaccccatgcacgatatttcatggctacgtcttcgcttgccacctctttcactgtcgtagaaagctgtacgtcgttcgagtcgtagaacataatcagattgttcagcccaaggtgtccggcgattcggccggctccttgtgatacttcctcctgtattcctccatcggaaatgtaggcatagatcgtttggctcatcatccagccgaagcgatgagcgaggaatttggctgcgatggctgcaccgacagcataggtgtggccttgtcccaaggggccggatgtgttctccactccgtgcatgacatctacttcggggtgtccgggtgtgatgctgccccattggcggaatgctttgaggtcatccatggagtacttgcccgtcaatgccagctgagcatacagcatcggggacatatgtcccggatccaagaagaagcgatcgcgaccggcccattgcgggttcttcgggtcaaagatcagatactcggagaagagtacgtttacaaagtccgctccgcccatggctccgcccgggtgaccgcttttggctttttccaccattgcagcggccaatactcgaatattgtccgcagccttgttcatcagctttttgtcattcattccttctaattatgttgaggtgagattatatcttaaattgcgattgtcctgtgaccgaagacatcttttccgacaaaggtaagaagttccgttcagagcacgtggtttactatattaaatagatgatctttcggaggtcaagctttgttcctctccccttaagtgcactgcatcaagcttttgatttcaaaagacaactggtcggagtccggggatcctc

SEQ ID NO: 1057 - DNA (genomic), 4465 bp, PORYPHYROMONAS GINGIVALIS; double-stranded, circular
  misc_feature 1...4465
  hypothetical: NO
  anti-sense: UNKNOWN
cggtaaatgaaatagaaacaaaacggttaaaagcacatctttgtttatttggattatcgtacacaaataagaaaattatagatatatatctatcgaaataaagattatcggattgacaaatcggaatttatattataataaatcctatcgcaaaaaatattttcatttatttggagtatatttgccgatataaataggcacatgagggaaataacggatattgctgtagccgaatctggtgatagtgacttcaaagagcggcttgagactaaaaatgctaaaagctggctgaaaagtgtaagcgcttttgccaacggaataggaggaacgctctatttcggcgtggaagatcgcacgcgccggataattggtgtacaggatattcaactgacaatcagcaaaattacagagctgattgtggctcgtatcaccccgcgtccggtttttgagtgcatccccctgcaacagaaaggaaaagatattctggctgtcagagtggattccggaaaacatactcctttctactatgttcacgatcatcaccatacagcatatatacgtatgggagacgagtctgttccggcgaccgattatcagctcaatgagcttatactgaaaggaagaaacgaaacatatgacagtcaaataacggagaaactgcgcacagattatagttttacattgttggaggcgacatatttgcataccttgaatcagcatatgtcagatagcgactatgtttctttcggtttggcggtagaagatggtcgtttgacaaacgccggattgctttttgccgaccaatgtccgttacctgacagcagagtcttctgtacacgctggaatgggttgcaaagaggatcagtgcatgaagatgcgacggatgatgcagaatacagtggcaatctgatatacttgttaaaaagtgccactgagtttattcgcagaaatacccgcaaaggatggactaaaacagctaatggaagagtggagaaacccgactatgccgaacgtgcttattttgagggagtggtgaacgctcttatccataggacatatgattttcgagggactgaagttcatgtggaaatgtatgacgaccgtttagttatctcatctcccgggggaatctatggagggggagaattggagcccatgagcgacggctcttatatttctaaaaggcgtaatccgatattagctgacattttcagccggctaaggtatatggagcgtcggggaagcgggataaagaaaatctttgaagcaacgaagaatctttatggctatacggaagaaaaaaagccgtttttccttgtgaataaacagaatgacttcttcctgacgattccgaacgttaattatcgttctgagtctgttaccacacatgacaccatacatgacaccatacatgacaccatacatgacaccatacatgataaaatcgccttgttactttccttctgtcaaacgcctcgcagcagagaagagatgatggagtttgtgggtttaagaaaccgcgatcattttcagaagaaatacctccgtcctttattagaacaggaaaagatcgaaatgaccattcctgaaaagccccaaagtaagaaccagaagtatcgaacgaaggaggtagtcaaataacatatccattctctaatataagcgttcaacaaattgagtttttataagaaatatcttcctgtgggtatgaaagaggcggtgactcattgtctggattctttcgtgccgttttatttatatcgtttgcccgagcggaagggaggacggctgggtttcggagtttcgctgagcggacgaatagagcgtaagacggcggatttttccgttccctgttttgttgcggctcctttcgattcggaagaagaggcttacttcattccgggggaattcgaatgcgagggagatttgacggataaggcggtgcgggatttgaaggatgccgtattctccggtatccgcatgccttgcccggaatccggagatatggataaggaagcttaccgtacggcttttgaggaaatcatgcgccggatagattccggggtattggaaaaggtggttttatcccgcaccttgacccttaagaggggcgattccggattctccgacgttttttcttattgggagttgctccggagggcttatccccatgctttcgttttcctttattttattccgggaaagggagtatgggcgggagcgagtccggaactcctgttggattatacgaaaggacgtgtaaagacgatggctttggccggaaccagacccgtatctttcgaaggcgagttgcttaagccgtggacacaaaaagagataagagagcaaggagtggtcagggactatatcagggaagtgcttgagaaccactgtcgcagcgtggagatgtcggagacccgtacctttatggccgggaatatttgccatttgtgtacggattttacggctttgaccggagacggcttagaaagcttgctcaaggcgcttcatcctaccccggctctcggcggattcccccgtaaggaagctttggcgtgtatccgggaggtcgaggtgcatgaacgcaaattttacggaggatatttggggcctgtgggtaaggatgctgcgagattgtatgtgaacatccgctcgatggaattgtttcccggggcattccggctttatgtgggaggaggtataaacggagattcggtattcgaagacgaatgggaagagacctcggataaggcggctactcttttgaatgtgcttggaatacattccgtcggagataaggcggactataaatgataatgcaagatgatggattcggattattcggataagaaaggcgtaagcgtattgatggatttattcgagatgaagggcatacgtaaactcgttatgtcgcccggttcgcgaaatgctcctcttctgttttctttctcccggaatcccgctttcgagaaatacgtgattgcggatgagcgttccgccggttttttcgctctcggattggctttggcctcgggtgaagccgtaggattggtttgtacttccggtacggccatgttgaattatgctcctgccgttgccgaggctttttacagggggattcctttggtcgcggtaacggccgaccgtccggccgaatggatcgaccaggacgagggacagacgattcgacaggagggagctatggccggtttcgttaagtcgtattgcagcttgagagcggaattcgatacttccgcctcggcatggtatgccaatcgccgtttgaatgaggtgttgaaccatgccctgatgccccggcgaggacccgtacacatcaatatgtcgttttgcgaaccgctatacgggacttcctccggatattccggaaaagagcgggcgataacgttcgtgagggaacggcaagaattgccggaagaggtatgggatatgctcgtaaagcggtttttggaagctcccagagtgatgatcgtcgccggtttttatcctcccgacgaagacgtgtccgccgcattgcaggatatatgcaaatttccccatacggttttgtttgccgagagtctctccaatatccgtacggatacggggatatgtacggcagaccgggtattggctgcagccggagaagacgaatcgctttatccggaactccttatttctttcggaggctcgttgatttcccgtatgttgaaaacttttctacggagggcgaaacctgcggagcattgggggatagacgagaggtttccggctccggacactttctgtgcgcttacccatcatatatgtacgggagcttcgggcttttggaaggaattcgccggacggttgaaagacaaggcaccggagtccctttcaccggaaggaatttcctatgccggttcgtggcagaagataaaacggaaggcggacctcctgcaccgtacctttatggcggatgcggggtggagcgacctcaaggctttcgaagtgattttaaggcatattccccatgatgctgctttgcatgcggctaattccacgcccgtacgttatctccaattattcgaacacgcgcattatgcgggaggagaatggagcaatcgcggaaccaacggaatcgagggggccacttccacggcaatggggttttccgaagtatattccggaaccacccttttgattacgggagatctgagttttatgtacgattccaatgctttgtggatgccttatgtaaacgggcggatacgggtaatcgtgatgcgtaacggaggaggggggatattccgttttattcccgggccggattctttgaaggaattggagacctgtttcgagactccgctcgaagttcccgtaagggaaatggccggagcttacggatggagatatatgaaggccgtttccgccgaagaactggaaacggtgttgccttcgtttttcgcatccggcgacaggcggtcct

SEQ ID NO: 1058 - DNA (genomic), 464 bp, PORYPHYROMONAS GINGIVALIS; double-stranded, circular
  misc_feature 1...464
  hypothetical: NO
  anti-sense: UNKNOWN
gaggactgattcagagaaaaacagtcctctaacattattgtagcatttggcatttattacaatcaatgtataatcatttttgccaatacacacttttacttgagagcaaacggtatcgctcatacgcatagcttttttaatgacataaatagggatatctatcgctacatctgtttcccatcttctaaaatccgagtaattccgaaaagattgtaatggcctttttatgtatattctacatcgnggcattatgtttcgagctcgccaaaaatttgtagaacctatttcttcatcaaggtactctattggatttatcaaccaattccgctttgaacatctctctcaagcgatccgccattacgggcttcgctttcttgtggaagaaaatactgtctngattagcattataccttttggtttaagccaattggaacctnaaaatttagccttggcagaaatacnat

SEQ ID NO: 1059 - DNA (genomic), 464 bp, PORYPHYROMONAS GINGIVALIS; double-stranded, circular
  misc_feature 1...464
  hypothetical: NO
  anti-sense: UNKNOWN
agttcccgaatccgagttcatccatcttggccaccatagctttggcacggcgcgcagcctcgatacgtccctgcggaagaagagccaactggctcaccttggccgatacgaagagcatagccgaaccgttcttgcatgctgccgcacaagctccacatccgatacaagccgctgcatccatggcctcatccgcattcttcttggaaatggggatagccgttggcatcggggataccccccgtattgacggaaacgaatccgccggactgaatgatcttgtcataagccgagcgatccaccatgaggtctctgatcacagggaagccggccgagcgccaaggctctatcgtgatcgtatcaccatcatcgaaacgacgcatgtgcagctgacaagtggtgatgctatcgtaccggcccgtggggatgaccattgatgtagagtgagcacataccgcaaatacctt

SEQ ID NO: 1060 - DNA (genomic), 899 bp, PORYPHYROMONAS GINGIVALIS; double-stranded, circular
  misc_feature 1...899
  hypothetical: NO
  anti-sense: UNKNOWN
attggctttcagggtctctaataggagccttgccgaatcgaccntgctcgaacggatgacctctttgcgctcactcgtccatggcttatcggcaactccggctcctgccagatggatgatatgcctcactccttgcagtgcttcgacctcgattcgccgtttgggaacgtcccattcatattcgttttcgtttcgtttgtggcgcgtcaaaatgcgtatggagtaaccgtttcgcacaagttcttccgacagtgcccgtgcaaccatcccatttgcccggtaatcaaaacaacgtctttctgcataaagaaacccacaaaattcaatccgctaagacaccgaaacaaatatataaaatgggatgcacaagaaagtgtacctcaatggaaaaatacgcaccaaaaaagttttcaacaacgaagcggagtttggaatgattctaaataagcatcctaaagagagggggcaatcggagtaaaaaagacaagaaaacggacttttgcaagtcgaaatccgcttttcggaagatcttgaaacgatttatatataaaccattttcaatttatatatagattgttttagatttatatataaaacgttttcaataaatatatagatcataaatgatttatacataaattgcaggataaaaaaggccgattcgggaggtgataaaacaaatgcacccaccgagtttaacagcaaactcagtgggtacccggtctcttgggtggattaccgaaggggtattccacccttatacatcataagtctatacgctctttttctctaacgcagtgagtggatgtgaataaaanggagcgactgtagcagtcgtatcggcagatggttggaggtcataatatcggtgtgcatatcaatttagcagtttattaatg

SEQ ID NO: 1061 - DNA (genomic), 588 bp, PORYPHYROMONAS GINGIVALIS; double-stranded, circular
  misc_feature 1...588
  hypothetical: NO
  anti-sense: UNKNOWN
gggacattcggtatgtatatcccaagaaatcgttcaagtatgaaaaaggaaaaactccgactatggatgatctggtggaagctttccttacagcttcgtaccagagtgagaccaactcggggctggggtatgacaagaacgccaatcactacctgattacatatgccaaaaaagaagagaacggtacgaacacgctgaaataccgctgggccaattatgacaagattcataacaaagatttgtggagcgacacatttacgtatacatcatctgccaatgctctctacacacctcaagtagacatcaatccgaccaagggtctcgtgtgctggtcatgggtggaatatctgccgggcaaacggatcgtttggtctgatcgcagtggacccatgccaacggtgtagaagacatcgtaatgcaagaaggcagcatgaagctctacccgaatccggctcaagaatatgctgtgattagcctgccgacggcagcaaactgcaaggctgttgtttacgatatgcagggcagaagtagtcgctgagcttcttcttcggcacgaatacaggctgaacgtgcagcacttggctaagg

SEQ ID NO: 1062 - DNA (genomic), 2234 bp, PORYPHYROMONAS GINGIVALIS; double-stranded, circular
  misc_feature 1...2234
  hypothetical: NO
  anti-sense: UNKNOWN
cgtccatcatgccaagagcagcagaaacaacgatacagaagcccgtcaaagagagcaacatattggggagtgaagattttagctttttcatttgttctttcctccaaaatgtttaggtttcatataagtgttgatcagaggtgtcataccgttcataattaggatggcgaatgacattccttccggataagccccgaatgtacggatcacgacggtcagcaaaccgatcagacagccgtaaaggatctgtccggacttggtcatcggcgaagtcacatagtccgtggccatgaagatggctccgagcatcataccgccggagaacaggtggaaccacggagtggccgggaaggatgtggggctggccaagtgcagaatacctgccagtacgatcacagatgcgaagatagacacggggatatgccacgtgataatcttcttgtacagcatatagaccaatccgagaagcaatgcgatagcactgacttcacccaaagaacctgcttcaccgataaacatgtgcaggtctgtggggatattagccaaagccgaggtgtcgccgctcattgctgctttcatcaggccgagaggcgtagcaccggtctcggcatccagataggaagtcatctgtccttcggtaggccagagagtcatctgggcagggaaagagatcaggaggaatacacgaccgaccaaagcggggttgaagatgttgttccccaagccgccgaaggacatcttgcccaatgcgatagctactactgcaccgatgataatgatccaaacgggcaggttgctcggcaggttgaaagccagcaatacgccggtcaagatagctgagccgtccatgatggtaggctccttgcccaacatatatttgctgatcaggtattccacgatgcaacaagtaagaacggatactgccgttacgatcaccgcaccgattccaaactgatataccgacatggccaaggcaggcaagagggcaatcagcacaccatacatattctttttgatgctgtctccgctgtggatgtgcggtgaaggagaaatgataattttattttccatcgcttatttcctttcttattgcttacgtgctctttggatacccatcacagtcttcttggcttggcggatataatccagcagaggacggttggccggacaggtgaagctgcacgaaccgcattcgatacagtcaaccacgttgcctttttccgctgtttcccagctcttatataaggtgtcgcgcataaggaaagccggattgagtcccatcggacacactccgacgcacttggcgcatcggatacagtcgcgcataggcttgcgaactgcctcttctctatcgagaatcaatactccggagctgcctttggtcacaggcacatccggtgacagcagagcgcgtcccatcatcggacctccgccgatgatcttgcccgtattctccggcaagccacctgctgcttcgatcaaagccgcaataggagtacctatacgaacgaggaggttagacggacgagacagtttttttcctgtaaccgtcacgatgcgctcgaccagaggcttgttcttctgtactgcttcgtacacggcgaataccgtacccacgttttgtactacggcacctgtgctgataggcaaggcaccgctttttacctgcttgcggatcactgcatcgatcagctgcttctcaccgccttgaggatattgcaccttcaacggcattacctctatgcccggatatgcagtggccagtttggtgaggtgagcaatagcatctttcttattattctcaactccgatgacggccttgtttacctgaatggctttcatcaggatactcacgccgatcatgatctcttcgccgtgctccagcataaggacatggtcgctcgtcagataaggctcgcactctacggcgttgatgatcaggatctcagctttgttgcccggaggaggggacagcttcacatgggtagggaaggtagcaccgccaagacccacaataccgggctgcagaaattttggctacgatttcttttgcatccagattgcattctttgacgatggctggtgagcgatcgatgccctcttcccattcgtcaccttctacgctaatgaagactgcgggcttgggatagccgcttgagtcgtatacgttatcgatcttcagcaccttacccgacacagatgagtggatattagctgatacgaatcctccggcg

SEQ ID NO: 1063 - DNA (genomic), 1753 bp, PORYPHYROMONAS GINGIVALIS; double-stranded, circular
  misc_feature 1...1753
  hypothetical: NO
  anti-sense: UNKNOWN
aggaataggatcgaagatcaacaattatcctatgtcctcgaaagtatcgtcacagagcgagacggacgcttgatcgcactaatcgtgccggacagacaggcgatagagcataaagggatctctccggatcaggcatgggcttatatcgaaaggagccgagccgaactgaacgggcaagtgggtgcatacgagaaaataacggcctttgtccgccatgacgaagagttcgagaagacacccaaacacagcatcaaacgtttcctctatacttgattgcgcaagatcgggtgcccccgtctgtaaaaggaatagccatgcgtaaggcttccggataaaagggctcaatgcaaacagcatttggtcgttttttttggtggtaccaaaagaaactgtatatttgcgccgttatagaacattaattacacttttaaccccaaaaggaaatgaagaaatttgttgcttttgcagctgtaatcgcagctgtatcattcgcttcttgcaactctcaggctaagactgaagaagctgctgactctacggctatggattctgccactttggtagaagatgcagctcctgtagttgatacggctgctatgcagatcgattctgctgcaatgaaggctgaagaagctactgaacaagccgctcaataatccaacggctatttagcatcccccgaatcatttgtggggtaagatataagtctgacttcaaaagagtcggacttatgtctctttttcagttatgaacttctcgccttagcgagctgttgcaacaaaaaagggtattcgttatcggtctttcagaggctttaacgaatacccttttttgatactgttgtcgatggaggctgtgtgtgctgagcaggctgttatctcatgtccttgagttgctgctggagttcctgtctggcaagaaatatacggctcttcaccgtgccgagagggattccaagagtctcggatatttcattgtatttatatccgctcacgtacatggagaatggctgcttgagagtctcattcagcgatgcaatggccgccgttatctctttgatggtcatagtgccatcgggcgtatcctctcctccctcattcaggagaggtacattgtacggatcgctgttgggatcgataaccgtttgtgagcgaaccaacttatgatagttgttgatgaagatatttcgcatgacagtgagcacccagcctttgaagttgacattatcaacgaacttgtcctcgttatgaagcacacggagagttgtatcttggagcaaatcctctgcatcatcccgattggcagtcagagtcagggcaaaattgcgcatattgtcttgcagactcagaagtttttcgcgaaattgcacactattcataataagctgtttctttgttgttgttgaagccaatggttggaagattcgttccctcctgccacagacacaaagataatcgaataggtgagaaaccctaataaacagcgtattaagcataatagacggcatcaatgacatgaaaagaaaccatcttcagaaaaggcggcaacctgctcgcaaagggtttgtggataagctcccgaccaccctggcggacatatcgtactatgcctcctactatcaagaaaatgctctggtgaacaaggtgctgaaatgctgcaggctaatcggccgcttcggtaccggacaagtgctgactctgtattatatgctacaggcgggggagataacaatgaaagaaaaactgctccttgc

SEQ ID NO: 1064 - DNA (genomic), 1003 bp, PORYPHYROMONAS GINGIVALIS; double-stranded, circular
  misc_feature 1...1003
  hypothetical: NO
  anti-sense: UNKNOWN
cgctaaaaatcccgtaaccgaaaactccggttacgggattttatttggtttttagaaagaggtgggactttcaagtgtaggtttcagtagcaaataccttgagtgaccggccgtaggtgcggatctcaatgcgcttaccgaacatgacaggatcgccatcgaggtgcattacgccctctgtctcacgctcaatgatcaggttttcggccttataggtgtccagattggagttgctgttgatacgcttggtaaagagttgtaaagccaattgtggagcttccaatggattgaaaggacggataataactacatccattttaccatcctccaaatccgctaatggagcgatataaggcgttattgccatactggggcgcattggcaccaagtgacgaggaaagctttctcctcaaaggatttgccgtctatcgtcagtttggatccttcggttcgttttggaggtaactctcgatcatggttcgcgcataagtgatagggcctcgactacccgcttgggcgaatttcttgctaacctcggcatcgaatcccaatccgcaggtgcaaaagaaagggcgactatccgcttcacagcagtcgatggtgcgaacatgtccggctctgatcacttcgagagctttcccgacggtgagtggcagcttgagggcacgtgccaacccgttgcctgatcctttcgggacgatacccagcactacatcggtgtagcgaaggctttgggctatctcgttcaccgttccatcgcctcctactgcaatgacgcagtcgtaatgcttctccactgcttgtgctgccaattcacgtgcatggccagcacgttgcgaataggtgataaagagttcgtgaggatcatgggcgaatacatcggctataaggctcggtatgttgcttttcgatccgatgcccgatatggnattgataatggctagaatcttcatagctattcanganttaatcttgtctgcctaatggtgtgtttccattctct

SEQ ID NO: 1065 - DNA (genomic), 522 bp, PORYPHYROMONAS GINGIVALIS; double-stranded, circular
  misc_feature 1...522
  hypothetical: NO
  anti-sense: UNKNOWN
aaatacgaattgatactccggtacgtagtcttttcggctgattgtcgcttgggcacatctggcatcctctttcatcagacgactgaatctctctgcgagatcgcccggtttaattgaagtcgtaaccgtatatatccagatttactgtgggttgtccgcccataccgccaccgcttccgcccggagtaaccttataactgtgaatctcaggataatcatccagcatggtacgtatctggtcggccacttcgttcatggagcgttttctctcgttgcgtccggtaagaccgatatggaaagtgatgatattcgtaccattgtcctgcatggcggcaaacatgctggaagcctcggcctgaccgacactaaagctcgttctgtcgatttccggtatttctttctcccaactgtcgatcatacgaagagcaaaggctcgtggcagattgactcccgtgcccaccggatattctgcctgaattggatatagccattgtcggactgagggaagaattcggtttgaca

SEQ ID NO: 1066 - DNA (genomic), 2058 bp, PORYPHYROMONAS GINGIVALIS; double-stranded, circular
  misc_feature 1...2058
  hypothetical: NO
  anti-sense: UNKNOWN
gttcgccttccggcagattctttgtggtggagcaggcacctgtcagtaggacaaaaaggatggggaggaatacttgccgtaatactttcatcggattcttatcgctttgtcggaatgatatccgtctgcacggataccggctcctcttcgggtttgagagcttctgctttcgacactatggttttcgtctctttcttcttgccgaaacggaacagatcggacaagcgcgccaactttcgactgatcacatagccgataccggtctccgttatctctccttcgagcagattttcattgttcttcttgtggaagagtttgaggtgctgtgctcctgatttgtccagacggtactccacggatacgttgtccaccaaagtcctttccttattggtcggcacattggagccggaagcgacagatcctccgatcacgacacggatcctgttgtcatagaactgtttgctgaagctgtacgtgaagtccgtatatgtaccgccgccatcggtgccatcgtgactttccataccgatgttcagtccggagccatcgaataccttgcccaaagcactgttgatcattccctgagcatagctgctgagtgcattgtcaaagttgaacccactcgattgcgaagccaaataagagcctgttgccaagagtccgatggcctgcttggaacgctcttccggccccatacttcgcagttgggtttggatagagaagtcctccggtgcttcgacatcaaacaccaaatccatattcttgagcgtttctttgacgatgataccaacatcgaaattcacctttctcgacgtcttgctaccgctctccatcacatcggcacgtactcgctgcactgctttgaagttgacgtaaggctcttgtgcattgccgctccactgtacgtagctcgatgggtcgatagtgaagacctgcttacccacgacggggagcgtatagcgcatggtgccgccaccactcatactgtaccgtccggtcaaactcatttccccgtaagccggcatagtgaaagtcatgtctcctcctccttgcaactccagatagtcttgatgtccggccgagagatcgacacccaactgtacaaccggatcaatatgaatccgaacaagcatattcatgccaccgaaggatgctctttccttttccatctcagcctgcgatcggatcatgatcgtatcggaaaagtccatgaaattcaccacatcgcccatccgactttccgtttccagatctgcaccagtatacacatacgtgcatgaagtgccaccgtgaatatccagagagcccgaaatcgcaagtgcttgcagaggaccgcgaagggaaagatcggtggaggcaatcagtttgccgtacagcaagtcgccctgatttcttttgctgtccaacacggtcatctcatctgccagcatcttcagattggctgtcatggctctggctcctgtcaggattacttctccattaagattaagaccgtcttgcgccttttcttgggcgcgtatctgataattgtcgaaaaccaatttgtgacgatcgaagaccagtggcttgtccgaaaaatagaatgtattgccgatcatcggcgaatagaccgatgcatcccgcatattcagttgaccatcgatcagagggctatccgttttaccggcgatagcaagttttccctcgatgaaaccggagagggaagctctttccgctccgataaatggattggcgatggcgagcgggaatccgttaaggatggcagccatatcgagattgttctcacggatgcctccatgatagatgccatcgagattgagggcagcatttccattgtagcttatctctgctgtcacgtagtgcgaatgatcgttacggggttcatagaacagagaggatgcaatgttgccgatagacttgccttcaaattcgaactcattgacagagagatctccggtaatcgtagtgataccgttctctccccccgtacgggatagtcgtgcataagcgaaaaatctgccggctatattaggaagaggagacattccggacgtattg

SEQ ID NO: 1067 - DNA (genomic), 518 bp, PORYPHYROMONAS GINGIVALIS; double-stranded, circular
  misc_feature 1...518
  hypothetical: NO
  anti-sense: UNKNOWN
cgcaggacgaagtcgttctgattcagcttccatgccaggaagagggctgtagtcaccttcgcaaattcggccggctggagtcgcaacggtcctatcaccagccacgaatgcgagccttttatatccggagctatcagtatggtcagagccaaaagccccaacatggcggcatagaagacgggagccagcgactcgaaaatatccgtctccatgagcagaaccataaagcctatcaccaccgcgagaccgatccacaggagctgcatcatcggacgaccgcccatcatgaaaaggtgggatatgtcgaagtcgtaacttgctccgcagacagcaaaccaaccggccacgacgagcagcagatacagaatgatgggtaaaccaatcgatccgtcccttataatcgncttcgatctctcttaaaagacattgctgtagtgaattgcagtgttggacatcttcgtggccacggcttcgnccttcggagacaggttgccttcgcggagataatacttcatcat

SEQ ID NO: 1068 - DNA (genomic), 1982 bp, PORYPHYROMONAS GINGIVALIS; double-stranded, circular
  misc_feature 1...1982
  hypothetical: NO
  anti-sense: UNKNOWN
ctgtgctacagcagcagtatggcctgatcaccctgcagatgggcttgggatcggtggcatatccggtcagaatggatgtagcagatctggtcgtcatattcctgacgatattcacactcagctacttagctgcctattatcctgtccactacttcatcaatcgcagactgaaaaatagctgacgaaaggcctcattcgagaatgaggaccatgtgcaaaagctttggaataaggtgtttgcgtatatcaaagttcgtatctttgtagcaaaggagtgccggctatgccgattagatgttcagcaaacgaactcggagaaagtacacgatgacagacagtatagttattatccctacctacaatgagcgggagaacgtggccaaaatgatagaaacggtcttcgctctacccaaaactttcgatattctgataatcgacgatggatcgcccgacggaacggctgcgatcgtcaaagagaaacaggccatctatcccgaaagacttcatctggtcgagagacaaggcaaattgggtctgggtacggcctacatagccggattcaaatggagcatcgcgcgagggtatgactatatattcgagatggactgcgatttcagccacccggtagacaagttgatcgatctatacaatgcctgcgccggaggagaagccgatgtagcgatcggctcgcgctatgtatcgggcggaggcgtcaaggactggcctaaaagtcgcgtatggatgagctactacgcatccgtatatgtgcgtctcgtgaccttgatgaatatatgcgacacgactgccggatttgtttgctaccgccgcgaagttcttgaaaccattgatcttgattcggtacatttcaagggctacgctttccaaatcgagatgaaatacacggcctattgtctcggatttcgcctgaaagagatacccatcactttcgtcaatcgtgttttgggaacgtcgaaaatgaacacttctattttcggtgaagcttttacgggcgtgatcaagctacgctactggcacttattcaaaggatttcccaaaagaaaatagtacgaaagagatgaaaattcttcttcgcaacgcacttatcaccaacgagggaaaaaccttccccggttcggtgatgattgatggcgcatttatctcccgtattatcgaaggagagctacccgcggatgacaatctctccgccgatgaagtcatagagtgtagcggtctgaggctattccccggatgtatagacgaccaagttcatttccgcgagccgggactgacgcacaaagctaccatcgcctctgaaagccgggcagcagtagcgggcggagtcacttcgtttatggatatgcccaatacgaatcctcctaccacaatgtgggagcgactgctggagaaaaggcagatcggtgcagacacggcatgggccaactacggcttcttcttcggtggcacgaatgacaacatcgatgagatcaaacgggtggacaagcatctggtacccggtctgaagctattcctcggttcatctaccggcaatatgcttgtggacaataaggaaacgctggagaaaatattcggagaatgcgacctgctcatcgccacgcactgtgaaaaagaggaaatcatccgagccaacaaagagcactacaaagccaaatacgggaatgatttggacatacatttccatcctctcatccgtagtgaagaggcttgttaccgctcatcggcagaagcggtggagctggccgagaggatgaatgcccgtctgcacatcctgcatctatcgacagagaaagaactgagtctcttccgcaacgatatacccacagcacaaaagcgaatcacgtcggaagtctgtgtacaccatttgtggttcagcgataccgactacggcagacttggcaacaggatcaaatggaatccggccatcaaaaaagaatcggatagggaagcccttcgtgcagccgtgc

SEQ ID NO: 1069 - DNA (genomic), 610 bp, PORYPHYROMONAS GINGIVALIS; double-stranded, circular
  misc_feature 1...610
  hypothetical: NO
  anti-sense: UNKNOWN
tcgcgggtagccttgttcgttttgacatcgggaaagctgacggcataaacagccgttttaccgtcgggagacaaggccatttcgctcacccgcgacagggtcatgaatagttccggcgtcaaatgctctccggtattcgttccggctgatggggtcatagcagccgaaccaatgatgcttgcagccatcatcgaaaagatttttttgttcattgtggtgatttattactgtattgcgttttattgtggaacgaaaatacgaaagaaactcgttatcccctcttttaacgagagttgaatctataggagaacaaggtttgtcggataaaagtgtaccgcccctgaatgaaagcatcgatgcaatcgctatcggtgcgataggcaagactcaatatgctattgcttctggcatacgaatatcttcacgtaaatccttcattacagtacgttttgaagaatattcatttttttaccggacagcaataaaaagaaatggatcgttctcagccggaaaaagtttttctgcagtacagaaaaagttgaaagctatactgcaatctttatcaaaggtttcggatatataaacgaagctttcggatatgtatccaagg

SEQ ID NO: 1070 - DNA (genomic), 734 bp, PORYPHYROMONAS GINGIVALIS; double-stranded, circular
  misc_feature 1...734
  hypothetical: NO
  anti-sense: UNKNOWN
ttttctctgataaacgatacgacttgggcgatgtcggacgctatcgtatcaataagaaactcaatttgaatattgatcctgatatcaaagtgctgaccaatgaagatattattgagatcatcaagtatcttattgagttagtaaattccaaggcatcagtagatgatatagaccacttgtcgaaccgtcgtgttcggactgtcggagagcagctttacaaccaatttggtattggtttggcccgtatggccaggacagtacgcgatcgaatgaatgttcgcgataatgaagttttcacacctatcgatttggtcaatgctaagactatttcctccgttgtgaattctttctttggcaccaatgccttgtcgcagttcatggatcagacaaacccattggctgaaataacgcataagcgacgtctgtcggcattgggccccggaggtctatcgcgcgaacgggccggctttgaagtgcgagacgttcactacacgcactacggtcgtctatgccctattgaaacacctgaaggacctaatatcggtctgatctcctccctctgcgtatacgccaaaatcagtgatttgggttttattacaacaccataccgggaagtaaagaacggcaaagtagatttctccgacaatggactgaaatactacacggcagaagaagaggaagagaagaccgtagcacaaggaaatgcgcctcttgacgaaaatggtcgatttgtc

SEQ ID NO: 1071 - DNA (genomic), 3880 bp, PORYPHYROMONAS GINGIVALIS; double-stranded, circular
  misc_feature 1...3880
  hypothetical: NO
  anti-sense: UNKNOWN
acgttgagcaccgtgtcctgttcttcgcaggcttcatacggtttcgcgcaggcgtttgtatacattctccacgtcccgatggcatcgtccaccagcgaccgatggcgatagccatacctccgagactcatcgtattgatggtcagtcccatcagtttgagtgtcaaaaaggatgcaaccagcgaaaggggaatggtgaccagcgaaatgattcgtggcacgagcattcatcaggaaaatgaataatacgatgacgacggaatatgcctccttcgtacagagcttttcgtacgttgctgatagaattttcgatgaaacgctcttgacggaatatgtctgtactcactttcacatcggaggggagagccttttgcagatcggccagagagcgatccaacctttcggtcagctccagtgtactcgtcgccggctgtttggtgatggtcacgagtacggcagattgtcctcgctcggaagcaaggcccaacttcggtgccttattgcccacccttacctctgccacgctttcgagcatgatgggaatatcatcgagactttttaccagtgtcttacccaatgcggcagcatcgttcgtggagaggagtccgcaaatgatatattcgttgccgtattcatacagtacgccacccgatgcattgcggttcatttggtcgacggcagcacgtacttcggccagcgtgataccgtagtgcttcatcctttcgggattgagcagtatctgatattccttgatgtcgcctccgagtactgtcacctgtgccacacctccgatcgagagcaagcgcggacggatcgtccagtcggccaaagtacggaggtcttggagagaggtgctgtcggccgtaagtccgataatcatgacttcgccgaggatggaggattgggggccgagcgtaggtttgcccacattgtccggcagatcggcaccgaccacggccagcttttccgacacgatctgacgagcacgataaatatccgtcccccagtcgaattccacccaaacgatagagaagcccgtagtggaagacgagcgcacgcgacgcacgtcggtagctccattgacggccgtctcgacggggaaggttacgaggcgttccacttcctcgggtgccataccggtagcctccgtcatcactacgacggtaggagcgttcaagtcagggaatacgtccacctccatattggaggccgtataggtgccgaccagcatcagcagtacggatgctaccaatatggtcagccggttgttcagagagaaccgaatgatcttgttcagcatgatcgaatatcctctctctttagtgagtatgaccttcaggcattacggacgaagtagcggccagtttcacctgatatactccatgagtcacaacattgtctccggctttcagtccggacaggattcgcacacgacgtccgttgctctgcccgagggtaacctcttgtttctgatactcctcttcggccaaccgcagatagacgaagtgcaatccctgctcttcggtaatggccgatacgggaacggagagaacttcttcctgagtattggagagcagatacacagtgacgaaagagccgggtacgacatcgcccacattgtcgaattcgaatgtaacggggatgtaggatgactgtgtggatgcacgcccgaacgagagcagccttccgttcagatcggacagctcgtagagcttgttgtcgtatgaagtctggaagttggcaccggagacattgcggacattcttgaaatggctctccgatacctccgcccgtagctgcaaccggcggttttgtgacacggtggctatgggttggcctacggatacgtattcgccctggttgaccatgcggtttttgatatatccgctcataggagacgccacgctgacccctcccgcaccggtgccggatgcttgggcttcgtatatggtcttggctgtctgatagtccctgcaagtctgttcgtattccttgttcgaaatgatctgatcttttaccagcttttcagcccgccggtgttccttttgagccgattcgtaagcgatctttgccttggttacgggatctccatccggcagatttttggcagagatgcgtacgatgcactctcctgctcgtacggaggctccttctgtaaaggccgaaccggcaaacgaaacgatgccgttggccgtagctgctatggtggcttcatcgccttgggcggagaggatctgtccgcttgttttgatcacatagttgaaagaggcaggtgccacttcctctacctgcaatcctactgcttcagcctgccggcatgagaagtgaatctcattggccgatgcggattttttctctgctttatctccatcatggtcgtaatcttcctgatgttcgtgttttagctccgctcccgactgaggggctgcattgcttgagttgcatgccgtgaggattgcggcggcaacgatatatagcagtgacaagtatggtttcatctttatgtttgtttttcctgttgctgtaaaatttttgatacgataaggagtacacaatcgtctgtgcctcaaagcccttcaggacagaggagaagatgttcgccgagcgattggtttgttcttttcgagatagaaaaaccaagaggatgatctccttcacgatcttgctctcctgtgtacggaaaaaggcacgaatatgcttcctgaaaatgcggtctgagaaaaaattttttctcgaaccggaaagaaaatttttacgctcgtaaacgaaaaatttttggcacgtgttttcgaatttttacgaaccgcaatttgatgatttctggttcgtgtttgtttggcggatcttccccgttccgtccgaaaaggatgggtgcttagcctgaggcgagaggtcgcgtgtagtatggcacatacacgatcgcttcagatgctgaaagcacacagcacgagatctgccctacgacagcctcaaaagaaagaaacggggactaatgggaacgatccttctgtcgcgccgaagaatgcgcaagcagattcaggaaaagatgaaaggaggggctcgcaagccatgggatggtcttgcttcggagggtgtataaaagacgagatattctccgtattcgggatcggccgaaagatcatcggtcgggtgtagcaatagatcggctacggcaaagagaatagggaatacatggatgtgatggggatcgtggcactcttcgcagagagaatatctgtgcttgagtcgaagttccgcaccggacaggtagaaggttttggctacgcaggtcggttcgctatgagtgtgctctttgtccgcaggggcgttctcatgacaatgttttgccatgagacatgccatacctttgttgtgatgatgatggggcataataccgatgatcagcacgacaagggaggccaagcctatgaagaatatggagagcttctttctcacaagcgatgcggttttggaacaaaaataagagttccttcttatatcaagtgtttttttgaccgatttccgtcctaatcgcgaacttgtctgaacgctgtacccagattgtcgataatatccgatgctatcagactctcctgactatagcgtccggcatagatgtctccggccaaaccgtggatataattgccgaggacacaggctgaagcaggaagatagcctgaccccaataggccggtaatgatgcccatgaggacatcgccgcttcctcctgtcgccatgccggggttgcccgtattgttgaatacgaccatgccgccgggcatacaggttgcactgaatgctcctttcaggactacatagacatgatgatgacaggcgaggaatcgggcttggcgcagccgttcatagtccgtattgcaatg

SEQ ID NO: 1072 - DNA (genomic), 673 bp, PORYPHYROMONAS GINGIVALIS; double-stranded, circular
  misc_feature 1...673
  hypothetical: NO
  anti-sense: UNKNOWN
gaccgctccttcgaagccctcggacagggcaacctcgagctggccgagcaagcactccgtcaggccatcaaagcctatcccgacttgccctccggctatgccctgatgaacaacctcggtgccatccagcagagacagggcaagccggaagaagcgctgctcacctacagcgcagccctgcaaaagctccctgacgacaagctcctgcgcacgaacagagccatgctcctgaccgaaatgggacgaacggacgaagccatattcgactacaacgaactactcagggcagagccggacaacgagatcttccactacggcagagccatgctctatctggccaaaggaatgtacggcgatgccgagtcggatctggaagaaatcctccgcgtcaatgactcctcgctcaaagcccgtctcggcatcgccctggtggcaacgatgaaaggcgaatacgacaaagccgaacggctctacaactacgtgatagacaaactcccgaaaaacgccgcagcctacgaagggcgcgcccgcctcttcctgaacaagggaatgaaaggctacgccctgcgcgacatcaacaaagccttcgaatacgccacaccgcctgccgcctccctcttcgtgctgcgaggcgagatcaacgccgccataggcgacaaggaaagccggcggc

SEQ ID NO: 1073 - DNA (genomic), 808 bp, PORYPHYROMONAS GINGIVALIS; double-stranded, circular
  misc_feature 1...808
  hypothetical: NO
  anti-sense: UNKNOWN
ctctagaggatccccaacttttttcagtacacgtcaggggttattcttttatcttgaattttgctcaaatctcatgagaaaacagatgaaattcgcttccccattttccttttttacccctccgagtgtcaacttttttcagtacacgtcatctttaatgcggtaaaatctgtcacttcgataaattacgagccgaaaatgctcggattgtggtctgtaaatcctgagaaaacggggcgagaattttttcgctttggcgcgtaaaaattttacctcccgagccaaaacgcaaaaaattacgcgccacgctttcatggctgtaaagccggcaatttttggagcctgaaccatcgtacggggggagggagtagcgatgtgtactttcgtggacttccgagtacaggttcaggctctatattgagccggttgtcccggtgtatcaggtattggttgtcttagggtgaaaacgccgattgcagggcattaagtcgccggctcttagctgtcggcaacctatagcgaccgatggaaacctctctccgaagtactgcttgcagagtaatgaataactctctaaagccggctttcgacaggttttctctgcacctgagtggactatactcgtatttagagaccattgcacaaagaggctgttctttctgctagcttgttcccggtgtgtttttgaccattctcgtctgttttgcagcctggggactaatattcaaggtgaagaacacatctaaatgctcaaaaacacaaggaaacttgttcggtattggtgagctggatttgtgcaatggtctcg

SEQ ID NO: 1074 - DNA (genomic), 330 bp, PORYPHYROMONAS GINGIVALIS; double-stranded, circular
  misc_feature 1...330
  hypothetical: NO
  anti-sense: UNKNOWN
ggaaacaaaacttaaagcatccttggntacatcttcctttttgactataggtaaatctncaatttgaacattccctccgaggaacttttgataatctctgnagtaagggacatgtacaataacatacttgagcaattcccaaaacagatgctctngntgctctcgtgatgatactacatgtgcttncctataagtttttctataggcaggcatccatttaactgcttttntaagccagtattntagacggtaggaggcattattaagcataaacatacttntaacgntcttatngtttaaccatgaaaganttattctntacttaaaaat

SEQ ID NO: 1075 - DNA (genomic), 656 bp, PORYPHYROMONAS GINGIVALIS; double-stranded, circular
  misc_feature 1...656
  hypothetical: NO
  anti-sense: UNKNOWN
cgtcaatggcagggtggcatctacctatcgcgaagaaggcgacgagtacgatattcgcgtgcgcttggcccctgagttcaggcgatcattgagggacttggaaaatatcctcatttatacgcctcagggcaaaggtgttcgtctgggagagctgggtaaaatagaagagctgtacactcctcccaccattgaacgaaaggatcgtcagcgtgtcgttatcgtagcttccacggctgtcaaaggagctgcattgagcgatttggtcgaagtggccaaagaaaagattgctcaactggagattcccgacgggattgactacaaaatcagtggtacatacgaggaccagcagaagacatttgcagacttgagcacccttatgctgctgatcgtgatactcgtgtttatcgtcatggcagcacagttcgagagtctcgtcgatccgtttgtgatcatgttttccataccgtttgctttcacaaggtgtcatagtcggtcttatcattacccaattaccactttcagcgctatgtcctttatcggtctgattatgctgatgggtatcgtgggtgaaagaaccggtattgtgctcatcgatttacactcgtctgtgtcgcgaacgccgtatgggcattctctctggccgtagtacaagccgg

SEQ ID NO: 1076 - DNA (genomic), 523 bp, PORYPHYROMONAS GINGIVALIS; double-stranded, circular
  misc_feature 1...523
  hypothetical: NO
  anti-sense: UNKNOWN
cttcagctgtttcgctcacagctacaacgatttccgtatagatgcggagggtctttgtaacagggttatactggagcggagcaaagtttactacctgaccacgtacatcgcgcaggatgaaaggatcgctcagcgtagcgatttcgcccgggaagaacttgtcttcattatagctctgtccgtacacgtaggggatttgatcaggattttcagcgcgagagataacacctttagagggagcgatcagcacatccttcttttcgatgaatttggaagaaactacctctaccttcatcgcacgtgtttcagaaacggcaagagaacgggaaagaatgggcaatataggcgtacctttctccgagatattgacaccttccgtgaaggtaggcacctgaactacccctttggaagtctgttcgcctgtgaactgaagattgtccatacggaattgcaccttggacatagactgctcagcggagagcagtcgtacttgtgggttgcgaacgcgctctgccggctgtgc

SEQ ID NO: 1077 - DNA (genomic), 739 bp, PORYPHYROMONAS GINGIVALIS; double-stranded, circular
  misc_feature 1...739
  hypothetical: NO
  anti-sense: UNKNOWN
ccccgggtgcggcacaagcatttctctgccaagtctacctcggccaagctgcgcctacgagagcaagaccaagacttgcgtaagaagcttgcacaacttctggcagagaatgaagactttgcacctgaagatgctctacagctcgcggcatggaatccctatgaccagaatgccgtcagctcattcttcgaccctgaatggatgtttggcctcgcagatggcttcgacatcgtgattggcaatcccccgtatgtacaactacagaataatgggggagaattaaccaagctctatcaaggatgtgacttcaagacttttgctcgtactggagatgtatattgcctattctacgagcgaggctggcaactactcaaagagggagggcacctctgctacatcacctccaacaaatggatgcgtgcagggtatggagaaaagacaaggctattcttcgcctccaagactaaccccaagctacttgtagacttcgctggagttaaggtctttgagagtgctacggtcgataccaacatcctactcttcgccaaggaggccaacgcaggacagactcaagcggtctccctgaataagaatgtccaaattggcggtagtgaattgtgcgaatatattcaacagcatgcaacagcctctgctttcatctcctccgagagctgggtcatcctatcccctatcgagcagagtatcaagcgaaaaatagaagccgtcggcaaacctctca

SEQ ID NO: 1078 - DNA (genomic), 5173 bp, PORYPHYROMONAS GINGIVALIS; double-stranded, circular
  misc_feature 1...5173
  hypothetical: NO
  anti-sense: UNKNOWN
aagggaatacctaatcattacttcacaccatagtgcaaacttcgtagtatcnctttcacnttttcgacctgattgcctnggatgattatttctccgtctttggctgctcctcccactccgcatcgctgcttgagcaggcgcgacagatcagtcagatcgtcggcggaaccgacgtgtccgctcacaagggtgacctctttgccccgacgctgcttccgatccagcgtgatacgcagacgttgtttctccggaggaagcgtctcagctacctcttcgctatcttcatgttcgtattggaaatcgggattcgtactgtacatgacccccagtctgttcttccagtcactcatattttatattctccataaataaaagctgccgaggagataccacaacctccacgacagcctttgttcctaatcaaataccgcgcgtcttagtgcggattagttcttttgggccgacttggtaatgcgcttgcgcggctcaggcatggtctcgacacgaacgatatgctcattcgcaccctcccacatgatctccttttcagctgtgcgcagataagctatctcatcgccttttttcaccacagtgccttgtgctactacctccgtaatacggccggtgaatgtaccaatagactttctcgatatagccaaattggttttcgatgtagcagaaaggctggccggtacgatattcggcaccgatagccggagcgatggattgctcttccgtatcgatttcccaatagagtcgtccggagcagggtgccacgatcggatcacatccggcacgcttagcttttttgatgtcttcgtcgctatatccctgcttagccatgcgatcggctttggctttgtccagatcggcattgaagcgctccttggctacgccgctcttgtagtcgcgatattgacggtcgtgcatggcaagctcgaatagctcttcgtcgtctgggccatactcccaaccgttctgatccatttccttgcgaaattcgtccaaggcatcaggataaaattgctgaggatcggcatccgaaaattccattcccttctcttttgccaaagcgatgatctccggatcgagtttgccgggcaaacggcccgatttgccgaggatcataccccatgtgttctggtcgatggcttgccaacgcccttcgccccgtatcatgttgtacacgttcatcagggcaacattcttcacatactggctgaaaggagttaccaaaggaggatagccaaggcgcggccatacatactctacctcttggaagagacgtaccagtagctgatcgatggtcatctccggctcgccctttcctttgaggaacatattgatacctgcatgtacccctttcaggtcggccatcatggatcccatcataccgccggggagaccgcatcccacgagcagcgagctcgtctctttgttcgacggatccatgaaatagcccaagaagtcgtctataaactcctgtgtcaggcttcgagctttcatgtaggcatccatattgatctccggcactttgaagccggcatccttgagcatctgctggatggtgatcacatccggatgcaccttaccccaagagataggctccatagctacgtcgatgatgtcagccccattctcgcaaacctccagcatggaagcgacagagaagccgggacctgagtggccgtgatattcgatgattacatcggggtgcttggtcttgatggatttcaccagctgacccgaggaaatgaggacgaccgataccggccatatctttcaggcagatctcggtgcccctgctgcgatcagctcatcggccagaatggagtagtactccaccgtgtgtacggagagaacgtgataccaaagcgtagcctgtgggatcatgccggcttccagtgcatatttgatggatggaatgatatgcgagcatcattcaggccatcgaatatacgtgtgatgtccacgccctgtgctttcttcaccttgtacatcagccggcgcacatcagccggtacggggaacatacgaagtccgttgagtccgcggtccagcatgtgggtctgaatacccgcttcgttgagcggtttggtgaaagcgcgcactgctttgttggggttctccccatacaggagattcacctgctcgaatgcacctccgttcgtttccactcgcgcaaagcaacccatctccacaataacgggagctatgcgttccaattgatcttttcgtggttggtacttgcctgacgactgccacatgtcgcggtacatcagactgaatttgatttccttcttcatattgttttcaagcgatttcgtgttgtgtacttgacttcttcctttatataaataccgactgtgatatgctaaaccacaaaagcaaaggtatcaaataattccatagttaatccggccgaaatgaatttttccacacccctgtagcgatgaagcggagcaccgccgatccatccatttccgaacagcccgaatcgaagaccggcataccccgtaatagactgatcgagaggtcacaagctgatccatcgcctcctatagaaacgattccggagagattgttcattcgggagtagatatcggtttgttttttggtgccgaaagacggagaattgccgagcctaaaatctcaaaaactcgaaccacaaggaaaatctttacgcgcgagatttttttgcttttggctcgagttttatttttttctcgaaccatcttttttcgatccgcaattatgctttttcatgctccgcaaccgctcggaaagcaattcctgctacctgtcgagaaaggcttcgacagcagaggccgtggtgcataccggctcccttatgtaataataggtatgcctcatgtaattctttcatcgatataacgaccaaacagatctccattatacagaacaaactgaagccatagaccaagaaagaaactcggattcagaactccgttcgagtgcttcttgctaaaattataaaattacaattgtgttgcacatatttgtgggatgtgcagcgaaggcaagttatttgctccatagtaaaaaaagattacctttgcagctgttacggatggatggaggaggcgacccgatcaaggttcctcctttttgtttatcccaatgtccaataagtacagagcgagatgatagacagagaacaaatcgttcggatcgtttcggattatttgtccaccggggagactttcctcgtggaggtggcgatacatccgggcaacaggatcctcgtagagctggatagcgcccaaggagtttgcatagatgagtgcgtagcactgagccggcacatcgaatcccaagtggatcgggacatagaagactacgaactggaagtaggctcgaccgggctgacgtctcctctgaaagtgatgcgccagtgggagaactgcattgatagcgagctgtccgtactgctaaccaatgggatgaaggaaaccggtcgccttattactgtcgctcccgaagctatcaagctggaagtggtacgcatggtgaagccggaaggagccaagcgcaaaaagcctgaaactcaagagttgacaatagtcatggccgacatcaaacaggccgtgcgtatcatataagcaatagtaaaaaagaatcaagagaatacaccataaagagagtcctatggccaagaagcaagagacgatcagcatgatagaatcgctggcagaattcaaagagctgaaaaacattgacaaagagacgatgatcaacgtcctggaggattccttccggaacgttctggcaaaaatcttcggatcggacgacaacttcgacgtaatcatcaatccggagaaaggcgacttcgaaatatggcgcacccgtcaggtagtagaggacggtgccgtagaggacgaaagtcgcgaagtgtctctgtcggatgctcacgagatcgaccccgaggcggaggtcggtgaggaagtaacggactccgtgaacttcgcttcattcggtcgccgtgccattctcaatcttcgccaagctctctccagcaagattatggagcttcagaaggaaaacctgttcaatacattcacggaacgtatcgggcagctcatttcggctgaagtatatcaggtatggaagcgtgaggctctgcttatcgacgacgacggcaacgaactcctgatgccgaagagcgagcagatcccaagcgactttttccgcaaaggtgagaccgttcacgccgttgtggagcgcgtggagaacgccaacaacaatcccaagatcatcgtatcgcgtacaagcggagagttcctcaagaggcttttcgagctgaatgtaccggagattgccgatggcctgatcaccatccgctgcgtagcccgtatcccgggagagagggccaagatggccgtagagtcttacgacgatcgtatcgaccccgtaggagcctgtgtgggtatgaacggttcgcgcatacgaggtatcgtgcgcgaactgagaggcgagaatatcgacgttacgcagtacacgacgaacaccgccctcttcatccagcgggcactcagccctgcacgtatatcttcgattcgcctgctcgaagcagagcataaggccgaagtattcctgcgccccgaagaagtgcctttggccatcggaaagaatgcctcgaatatcaagctggcatcggggctgacgggttatcagatcgaagtgttccgtgacatagacgatatggacgaagaagacatctatctggacgaattcaacgacgagatcgaccagtggatcatcgacctgttcaagaatatcggttgcaatacggccaagagcgtgctcagcaagaacagagaagatctgatcaaagagacggatttggaagactccaccatagactatgtactcggagtcctgagtgccgaatttgccgatgaggatcaggtgactgataatcaaagtaccgattcggatgatttggacaatttctctgccgaagacgatctgaagcaagagtaataagaagaacaaaagcagtctcctccccatccctcatcttatagtacaatcctcacaaaggtgcagcataaatcacagaagaagaaaaggttagtatgtcaatnaaanaattcagcttagctaaagagttaaatgtaggagtaggctccctcgccggctttcttcggaa

SEQ ID NO: 1079 - DNA (genomic), 433 bp, PORYPHYROMONAS GINGIVALIS; double-stranded, circular
  misc_feature 1...433
  hypothetical: NO
  anti-sense: UNKNOWN
ccagacagcatttcgatcagctcattgtcgatcttcgatgccggcagtaggatcgtcatctttttgatcaatgtatcggccacttgaggtagcagttcgattgaggtcacgaccaattccatttcaccctctttccacttatgaggctgaacggatgcgcgaatgaggagatacagcccctccttgcaataattgccgaagtttacatgagcctgtccgaaaagaggtatttcgcccgtgccggacagatcctctaacgtaatctttgagtacggattattcgagcgagagattccctgaaaagccttggtaacaataccggccaaaaccaaatttttcccgaccaaggaatcggatcggtcaaatcggctgcatgggtattgcaatagtggatcgagaatgacttggtactgagcctttggattggaactaa

SEQ ID NO: 1080 - DNA (genomic), 676 bp, PORYPHYROMONAS GINGIVALIS; double-stranded, circular
  misc_feature 1...676
  hypothetical: NO
  anti-sense: UNKNOWN
ttccgctaaaagattctatcaaggaaagagccttgtaatgataatccgaagcttctgccaaagcaccgatacgacggctatccgttccgagatgattccatgcttgtgcggctacgatggtgtcccttagattcaatgcagcgttcaaccctttttggtgatatagcatcgcatctgtgtattgggacatattacgcatccgtttgccgacctcgatcgcgaataacatttgtcccacaaggttcttgttctgtacgctgttctcgtaaagctgtttaacagaatcagtggggagttctttttcgtacagcaatgcagtaatacgctttttctctcgggcgatttcagttacagagtgtttttctttttttccacatccgaccaaaatcgacaatatgagtaataataatgggaaaagtttcttcatttggctttctatatgcaagtcaattccggtgtaaaactaatcaaacatggataatctgacacataaatatggtttgtgaaacaatattgagaggagtgcgaagcgtccatttgaattatttcctatatttgcggagtcggtgccggtaaaaaagatgaataaactttttcttcgtcttcggcataaagacaaactaaaaaagaaaacagagaatagaagtagtggaagctcatggctttcgtcacttcg

SEQ ID NO: 1081 - DNA (genomic), 536 bp, PORYPHYROMONAS GINGIVALIS; double-stranded, circular
  misc_feature 1...536
  hypothetical: NO
  anti-sense: UNKNOWN
cggattttccggaattgctgtcagaagtcgagacgatagtctactccggtactcgaatcaatatcgactacttcatcaacgaggtcatggacgaggatcatttggaagatatattcgagtatttcaaagaatccacgacagactctttggaggaggctatgcaagaactcggtaaggactattcggaggaagagattcgtttggtacggatcaagttcttatccgaaatggcaaactaatgcatcagtttatgatgctataatacggtacgaaagatgaaaaagaatggaatgcgcatctgcataatcatgttgtcgttgctctactgggcactcccctcaatgggacagaagaaccgtggatcgacgaagtcgtatggatggtggggagacgaaccgattctgcgctcagacatagaggctaccaaaacgttttttgctcagttcgggacgccctcttgagggaatgcagactgctatattcctgagcagattgccgtccaaaagctttttctcaatcaagccaagatggacagt

SEQ ID NO: 1082 - DNA (genomic), 521 bp, PORYPHYROMONAS GINGIVALIS; double-stranded, circular
  misc_feature 1...521
  hypothetical: NO
  anti-sense: UNKNOWN
atgccattcgggcgatgtaatatgggagaactggtctttgccacagaggccttgcgcaaggcaatggaactacgtcccgagtttgagacccgttattatctgactgaagcattgcttcgacgccatctcacggaagaagcgttggctcagatgaatttactccttgaggaagttccgatgcatacagcaaccctgctcaaccgtgctaagttgaggttagaacaaaatgatccgtcccgagcacttgaggactgtggtaccggtatcgaatctacatccgaattggaggaacaagctcttttcctctattacggagcctccgccatgaaggacatgaaaaacctcaagagatgccctttgcctgctcaaacaggccatcgaaaaaaaatgatgccttcattccggccagactccttcgagcgcgcatactcattgacttggagcgctatgaagaagccacccaggatttggattgggtggcagcattccgatccggaagaggaacaggtgcctatgctccg

SEQ ID NO: 1083 - DNA (genomic), 2200 bp, PORYPHYROMONAS GINGIVALIS; double-stranded, circular
  misc_feature 1...2200
  hypothetical: NO
  anti-sense: UNKNOWN
atcatagttgatgacgaagagtccatatccatccacgcagggaacttgtcgcgaaaacgctgcatcgcccccttatcgagcgtatggtacagcaccttttcctctccttcggcacaagtggcaagatactcgccccgaggcgaaaggatagccgaatcgcccgtatagcgcagaccgataccgtcctcccccacccgattgatgccgcacacataggcatagttctccatggcacgagcttggagtagcgtttgccagacggcgcgacgcggctcaggccagttggccatgcagacgagcagatcgtattccagatccgtattggtacaccagacgggaaaacgcagatcatagcagggaatgatgaagatcttccaaccgcgatagttgaagatccggcgttcttgtgccggagtcatcacctcatgctctccccctacacggaagaggtgcctcttgtcctgatggaagacctctccttccggtgtcacgaaataggcacgattatagaatttcccgttctcccgtacggccatcgtagccgacagagccaaaccatgacgagcagtcactctcttcaggctcatgatagtttcgccctcttcgaaaggctccgccagagcttgtacgttcatcgaaaagcccgtagtcatcatttcgggaaagaagaggacatccgccataccggctgtttcttcggccaaacgctccattcggcgtagattggcgtgcttatcctcccagtctatccggcattgagctacagcaactctcaatggctgagagctctcgtgtttgatcatatttctgattctgcaaagtttcgggggtgccgtgcctgtgatgccctgtaccgacttctgatgtaggcaatatccgcttcttcattgcccgtaggggtgaacagctcgaatacgctcatttctttatagctatagtcgatcacagcgagctgaataggcactccggctcctacggcgatgcgatagaatcccgttttccactgaggagaatagtcccttgtaccctccggggtgatagcaacattgaaaacagcatgccgctgaaaaaattcgcgtacttgttcgacagtggaacctcgcttcgagcgatcgatcgggatacctcccatagccctgaagatcggtcccaaagggaagaaaaaccattcctttttcatcaggaagccggctttccgaccgatagaccaatagtagagtttgcccagcaaaaagtcgtaattgctggtatgaggagccacgcaaatgacgctttggagcggatttgcagatgggacgagggctttccagcccatcatcctgagcaacaatcgtgagaaaaacttcaaaacacctctatatgttacgctatttctgcttaatgcacgtaagtgacaaatcaattatcagacgcacacgccgaaatactcttcacgatctcggacagctcttccttgaaatcatccacgagccggcgataatatttctttacgagtgcaggattgtgcttaccgtcgttgcaacgaatcttggcaatggtggtatcttgaagttggagaatacgattgaggatagtttccacctctgcgtttttttcctctttcacaaagagtttgagcaggaatgcatcagtaaagacttcggaaatggctccggttatctgctttttcagttttctttcgcttgccatgctgtcaatagttttgaatgtgtatgcaagaaacaatatcaatacaaacttacggaaaaaatcaaagcctatccccgtacatcgtaccaaatagaacaccttatgtagcatacagcaaagctctcttatttccatgtcgagcaacggccatcccctgcccttcttatgagcaatcgacaggacagacacaaatgacacacatagttcatcaagcctcttggaagtcgcaggaattggctacatttgcaaaaacacaaacgacttcaacgaagctaaatatctctatcctaacacttatcatccgaattaaaaacggcttaataatgaacgcgtatattcatccatttatgctccttacccctcactctcctattatctttgtcttatctaccgtatgccaatccggtttcggacaaaagagcattttctcctatgatgaatagtccgaaataaggttcccatactcattccaaaagacaaggcacccgccgagttcgctatgcaactcgac

SEQ ID NO: 1084 - DNA (genomic), 540 bp, PORYPHYROMONAS GINGIVALIS; double-stranded, circular
  misc_feature 1...540
  hypothetical: NO
  anti-sense: UNKNOWN
cgagcctctgcctgcctctattctggctttgcccgacaaacgcggcgtgaaagacaaagtaattaccttcctgggacgaatcacgatgcagaaaggcccggaatacttcgtcgaagcagcggccaaagtactcgaacgcacatccgacgtacgcttcgtaatggccggaaacggcgacatgatggacgccatgatcaggctggctgcccgacacaagatagccgaccgcttccacttcacaggatttatgaaaggcgaacaggtgtacgaggtatttaaggcaagcgatgtctatgtgatgccatccgtatccgagccattcggcatctctccactcgaagccatgcaatgcggagtcccctccattatttccaaacagagcggatgtgccgagattctggattacgccatcaaagtggactattgggacatcgatgccatggcagacgccatgcatgcgcttatagcttatccggaactgcatactttcttgcgggacgagggtctccgagaggtgaacaacatcaagtgggagactgc

SEQ ID NO: 1085 - DNA (genomic), 621 bp, PORYPHYROMONAS GINGIVALIS; double-stranded, circular
  misc_feature 1...621
  hypothetical: NO
  anti-sense: UNKNOWN
tctanaggatccccgggatcattccgcaaggggatgggcaaacactatcactgagtgctcagaccaatggaaagtactatcagcagtatagtgtcacatttatggatccatggtttgggggcaagcggcccggatatgttcagcttcagtgcattctattccaagactacggcgattgactccaagttctacaatagcaatgccggcaactactataatgcctactataatagctactacaacaactataatagttattacaacggtatgtcgaactataccggcgacctctatactcaggccagcgatcccggatcgttcgcttcagatgttaggtacttcgatcggttacggtaaagcgtttgacttggccggacaattggttccagatttatacttctctgaactacacctactatagactgcgaaattggagctacaataccttccaaaatttccatcatggctcgctaatgatctcaacttggagcctgcgtctctctcgtacttccatcgataatcctatttataccagagccggatcggattcatggttttctggtgctgctactcttccttattctttgtgggacaatcatgactatgccagccagaacttca

SEQ ID NO: 1086 - DNA (genomic), 633 bp, PORYPHYROMONAS GINGIVALIS; double-stranded, circular
  misc_feature 1...633
  hypothetical: NO
  anti-sense: UNKNOWN
ctccttccagtcctgatctttgatgaaacccagacgctcaagctgtttggggtaataagcgtagttataaatggtagccatcgtacccagctggtcgaagccttcgataagcatcccttcgtggtccatatcggtgaaacccattggcccttgcagcatatccatccccttggagcgtgcccattcggatacggcatggaaaagggcatctacgacttcattgtcgttgatgaaatcgacgaacccgaaacgagcgttgttctgattccaagtttcattggcacggtgattgatcataccggcgatgcgtcccacgatccgcccttcacgataagccaagaaatagatggcttcgcagaactcaaaagccggattgcggtctttgtccaaggtcatcatctcatcatcgatcagccccggcacatggtagggattatttctatagagatctatattgaactgaacgaatttcttcagctcggctttgtccaatacttctcttatttctacagccataaaactcgtatttagtttacctaagtagtcaaaggttacaccggattttggacctttcacgcacaaatataactgaaatagttaatcatttattggataaaatctgcatctactgga

SEQ ID NO: 1087 - DNA (genomic), 830 bp, PORYPHYROMONAS GINGIVALIS; double-stranded, circular
  misc_feature 1...830
  hypothetical: NO
  anti-sense: UNKNOWN
ggttcaaactggccaatatgtacgtacaggccggagagatagacaaggccatatacatatacaaccgtatggaggcacaaaatgctgtcaatgcagcagatgcctccaactatgctgagattcgggcacgtctctacctgatgaccggtcagaccaacaaggctctgaacgaacttcgccgtctatgcaatcgattcccggaagtgaatgagtttaggctgaagtatgccggcactctgctcgacagtgagaagtacgacgaagcctacgagcaactgcaactgatagctcggacggattcgacaagtggcttgtatcattttgctatggccagctattacttgggaacgaacgaaaaagaagctgccatcaacgaaatgatcaaagtagccgctgacaaggatgtggcaccggagcagaaactaccgatcatcctgcgctttatcggtaccgacacagacgaagaggatgcaccgaaaaaagagtataatatcctgcttgaaaagatacttgccagccatcccactgaggtggatgcacgccttttctatgccgagctcttggaaatgcagggtgattctatccatgccatggaggtttgccgacctatcacggagtttgctcctaaagaagaacgggcatggaaattcatgctgggaagagctgttaccggccagaaccataccgaagtccatcgcatatccgaacaagcgcgacaatatttgccgggtgtgccgctattttacctctacgatgccatttcctattatatagagaaaaaaggttcagaagccaagcacatactgcaagaagcattggagcatatcgat

SEQ ID NO: 1088 - DNA (genomic), 410 bp, PORYPHYROMONAS GINGIVALIS; double-stranded, circular
  misc_feature 1...410
  hypothetical: NO
  anti-sense: UNKNOWN
cccagcatgaagaccataatcttggccatgctggcgcgtatcgatcgcacgagcatatcgcctgccgagacgaggttgttcaggctcaggatacggaagatcctcagcagtcgaaggatgcggaagaccatcagcacctgtgctccgctatagacaagggctatataggagggaagtatggagatgaggtctatgatgccgtaaaaggaaaggatgtaccgccacggtttatgaaggcagtagatccgcaggatgtattcgatggtgaatacaatggtgataacccactcgcaccaatgcaaaaaattccctcgtgctatgggacaggccttacggtactttctgctgagacgacaatgacgctcaagaaaggatgaggcatagcaggagaatttcgaagaagcgttccg

SEQ ID NO: 1089 - DNA (genomic), 806 bp, PORYPHYROMONAS GINGIVALIS; double-stranded, circular
  misc_feature 1...806
  hypothetical: NO
  anti-sense: UNKNOWN
gacgcaattcttccaaagcatcggcttcagccataaggctattttcctgagcctaacgcgccagatcatcttcctgattccctgtttgctgattatcccccgattcatggggttggacggcgtgtggtggagtctgccgatcagcgatctggcctcggtcgttttgtcttttgtgctaattaccatacagatgaagcatttcaatcaatcgaaaaaaactactttcgcggagtaattgccttacaaaaccgaatccttttcatgactcagataatcttaccggaacgatgaaagtatttctcgaagcctttctcctacaatatctcctgaccctctacatcgcataccgaggaggacaggccctaccgcaaaagagcctttggcgcaaaggttttcaccttctgatgggtgtagtattcaccctgtatctaatagggtttgccggcaacagggttttgcccgatgccgtgatgagctgcattatgtctgtcacaggcttctggtttgtcatgtccatttatgccatgtttgccatggtgatcgtagagattgcccgtgtcgtggacaagcgtttcctgcacagattcgacaggctgtccgaaagagtgcaggctcgcatccgattggggctgttcgttctcataggtttgtcctcggctttactcgtgatacatggactgaatatcgtgcgctatcccgttgtaaagcatatggacattcgtctggacagacctgccatagatggaaggcagtccatgaaagtagccctgctcacggatattcatattagcgaaacggtgacggcc

SEQ ID NO: 1090 - DNA (genomic), 18431 bp, PORYPHYROMONAS GINGIVALIS; double-stranded, circular
  misc_feature 1...18431
  hypothetical: NO
  anti-sense: UNKNOWN
aggatccccgggcacaatcattaaaagaatcctgcacaaacgacttgcggcaaacaaatcgctcatgcaggatgcaactttttcctatcgacctctctcttagggaacgatcactttggctgtgctgtcaccggctcgtacaacgtatacaccggatgcaactgcaatgtcatgatctgcaagcacggcagcattgtaaatccgatgtccttgcatatcgtacacctgaacagatgtgcccgcaggagcacccgcaatgaatatccgaccggcagtagcccaaatacggatctcatgggaaatgggagcggccagagaggttattaccggtttgttgtctttgaggtacggccaaccgttgtttgcgtcgtttgcctgaagccagggagcaggattttgatctgcattgagcttggcagccatatcggcagtcttcattgccgcttccggcatacctgcgatggcaggtatttcgacgcccgtttcctatgccgaccatacccgggttttgttcgttgttgtagaagcaaccgtcgtatttgcagttcatggattcatctgccgtcataccgacaaaagcaccgggattttttcctcccgttactttggctgacacgtagcagtgcttggcaatgaagttggctgatacctgaccgacaaaccctccgagaacggcttgatcaccactgtcaagcgatacgacttccacattgagagcatagcagttggagaaagtagactcggttccggggaagaaagcaaagtttatgccgacaaatccaccgatcaacccaacgtctgcgattatcttgctgtccgttacgaagcaattctttacttcgcacagattgtatgcctgggatatgaaagcaccgctttggctctggctatagacttccacacgagtggcagagcaattttctatcttggattcatccaaaaggcctccaaccaaagaccctgcaccactgcctccgaagctcgtttcgtatggagcggaaacgattcgacagtcataagcatggcagttgcttacgagtcccttgttgtaaatgttgcaaacgagagcacctgccggggccgaacctacgaccgtagcattgcggatgattgtattgcgaataatggcctcgttggtttgtccgaagaatccgatgaatcccaagacgggatcgctgatcatcacgcccgttattgtatggttgcctccatcgaaagtgccggaaaaggggttgtcattatccttgccgatcacctcatcgaagcgattagccgagaagtccacgtcattacccagcttgatggtcacacccttcatggactttccgctgttgacgagcttggccaagcctgcaaactgctccgcagtggtgagagtgaattccgtgccgtctgccgtgtaccaactgacatcagcatggctgctccatgtggtttggggcatggcggcactccattcgtcagctatctgctgagctcccctgccgaacgaacgatcggaggtgtgtgtcgactgcaagggcgtcatctgcggttggctgacagccgaagccggaattgtggcaacgcatagagatagtactacgatgcggcctaaaagtctgcttcttttcatacttgtattggtgataattattggtgattttagaatgagatttttcgatcgatccttggcatttgcgaaaaaagcaaagagtttggggagaagaaaaatatgcttgcgaataatttttccgcccgctaaagtagagaaaaaaccaccaagtcggcgaaacgatgtgaggagggaaaaaatcctccattggcctatgaaattatttacgaaccacaagtacgattttcttgagacatgacgttattattttgagtagttttgtctaagaacttaaaaatagaatagcgactatggctgtgaaagacaattattgcgtcattatgggagggggaataggaagccgcttttggccctncagccgtgaatcccatcccaaacagttcctcgacttcttcggcaccggacgctccctcctgcagatgacatatgaccgtttcgcacggtttatcccccgggaaaacattctggtcgttaccaatgaactttacgtggacaaggtgcgcgaacagcttcctgagatcgaaccggatcaaatcctgcgcgaaccgacccgtcgcaatacggcaccctgcatcgcatatgccagctatcacatttacgcgcgcaatcccaaagccaacataatcgtagctccttcggatcatctgatcctgcgcgaagacgaattcgtgcgtgctgcatcggaagcgttggagttcgtagccgatcacgagcatctcgtgacgctcggcatccgtccatcccgtccggagacgggctatggatatatccaaatggctgaagaaaagaccggtgattttatccgtgtgaaaacctttacggagaagcccaatgccgagatggcaagcatcttcctcgccagtggagaattcctgtggaatagtggaatgttcgtatggaacgtggagagcatccttgccgcattccgcaagcatctgccggaagtaacctcttctctcgaaaatggcttggcacacttcaatacacctgaagagcggcgtttcatcgatcaggctttcccctactgtccgagcatttccatcgactttggcgtgatggagaaggcggacaatgtcttggtcatgcccgtggacttcggctgggcagacctcggcacatggggatctctctatgagctggcacagaaagacgatgccggaaacgcatcgctcaagacgcggacgctcttctacgaggccgaacgtaacatcgttaccacggacaatccgcagaagctcgttgtcgtgcagggtatcaatgactgcatcgtagccgaaagcgggaatgtcttgctcatctgcagagccgaggaagaacagcgcatcaagcacttcgtggccgatgccgctctgaaatacgataaggaatacaactgattgacaaaggcaaagaaggagcttcgacaagactgtggagcatttcttacaatacgtatggcagcaccgcctctatagctcgttaagctatggggcggatgctttctttttggagcctgaggtcattgatccggggatgctcaatcgggatagtggccccgatttcttcaacgccaaggtgaaagtgggcgatctcctctgggccggcaacgtagagattcattgcagggcttcggattgggtccgtcacgggcatcatctcgatccggcttatgacaatgtagtactccatgtggtagagacggatgacctcccgatacggcaccgaatcagcggtgaacctgtccccgtttgcgttatgcatgtagacgaacggcttagggcaaacgccgactttatgctccggacgtcccttttgccgggttgtaaggacaggctccatgaacttgatagcctcgaagtccacgactggctggacacgctcgtcgtagaacgattggagcgtaaggctgccgaagtggatcggctctatctgtctacgtccatggattggaatgcaacggcctatatcctgttagctcgtcatttcggattcgggctgaacaacgatgccctcgagcggcttgctcgcagcctgccctttgccgccatcgccaagcatcggagcaatctcctgcaagtggaagccctcctgctcgggcaggccggtttgttggccgaccttgaggatgaatatgccgagaagttggcttcggaatacgcttttttgagacataagttcgacctgcagcctcttgatccctctctctttcgtctgcatcgcgcccgtcctgcctctttcgtacatcgtcgattgggacagttggccgccattctgcatcgctgcgagttcctgttttcttcttttgtggagactgtgtccgctaaagaactggcacagaagctcagcgtggaggcatcgtcttactgggcttcgcattatcgctttgggaagcccacccctgttccttcccgtagtacgcttgccgctatttcgtcggatgccctgctgatcaatgtagcagccccacttcgctatgcttggttgagggggcagagcatggaggactaccgcgagcggacaatagacttcctgcgtggcatcaaacccgaaaacaacaagccggttcgtgctttctcccagatctgccgacctgcggatgctgccgaaagccaagccctcattcagctctatcgcgaatactgcgagcgacgcaaatgcttcttttgtcgctggggctatcgcttgctgagctgctgcaaagggtaagggtgcatcggtttcgggaagaagtccgaggccaaacacttcgtcatttactaccggtccgtcaatagggaatatgtaaggcggcttactgtctcacaagaggcctcccacttgattttatcgctttatcatagcgaattgcatcgcattgcaaatacgtttttatagatgctgtctattagagcatagatgaaaaacttgattgtttttgtaattttgaaacgttttcagagcatgtaactaacgacgatttatcacaacacaagaattatgtcacaacaagatgaaattatctgccactgcaacgaaattacacgtggagagattgaaaaagcaattagagaaaaaggattgaagaccgtggatgaagtaggcgaagctacagacgcagggactgtatgtggttcatgccaagacgaaatccaagctattttagacgaaatcaacggttaatgtagaggtttatccctctcctttctgatctacgcccgtcagcttaggcccaaaagccagtagccgacgggcgttcggtattgagagaagtcctatacagatccgacatttatgttttcggacggtatccgatgagtagttttatcggatatccggggctctcctcttcttctttttgtacccacatcaactttttctacgcgagttcttgcacatctacggctcgtgtttttcggaagaagtggcgcgagatttttttcgttctggcgcgtaaaaattttacttctcgcgccaaaagcaaaattttcccgcgccacgttttccgagacatgaataaagaaattttccgaacgcaaacaatctgaacggacagtttgccatgtactgaaaaagtcgttgacacacggaaaggttgtgaagatcgatttccggctctgctcgatctccctttcccactaatccgacagatactgatgcccgcttaccccgaaaaaagagggagaaaaacgcttgtacaactaaaaaaagatactacctttgcatcgcaatcgcggaagtagctcagttggtagagcataaccttgccaaggttagggtcgcgggttcgagtcccgtcttccgctccaagaggcagtaggcatgcggcctatggcggtctcctcatcctgaaaaagggtgtatctttccaagaaagatcggtcgataacatagacgcccgggtggcggaattggtagacgcgctcgtttcaggtgcgagtgttcaaaagacgtgcaggttcgattcctgtcccgggcaccgactatcgaggaaaagacaaacaatttttttgcgcgggtggtggaattggtagacacgctactttgagggggtagtgccggttacggtgtgtgagttcaaatctcatctcgcgtacttttaatgaagaggatgttcattcgattgggcatcctcttttttttgtttaaggaaggtgcccaatggcgtgaaacggtataaatagatatctttaatctttgtataataaaaaacaggcagaatgaagcagcaggaaagcgagcatcccacaagtggcgaagccatcatcatcaaaggggcacgcgtcaataatctgaagaatatatcgctgactataccgcggggcaagctggtcgtggtgaccggactatccggttcgggcaagagttctttggctttcgatacgctctatgcggaaggccagagacgttacgtggagagcctgtctgcctatgcgcgtcagtttctgggaaggatgcgcaagccggagtgcgacttgatcgccggtgtgcctcctgccattgccatcgagcaacgcgtagtaagccgcaatccgaggagtaccgtagccacatcgaccgagatatacgagtacctgcgcctgctctttgctcgcgtaggcaggaccatctctccgacaagcggagaggaggtgaagaaacatacggtggccgatctggtcgcttacgttgccgatcggcccatcggctccaaactgtatcttctggtagggctgcaagcccctcaaggacgtagtctgcgtgagcacttgcagatccaacagcagcagggctatacgcgcattttcgttgccggggagatgaagcggatcgaggacattttatccgccgaaactgatttctccgatacggcctcctgcttcctgcttatcgatcggctggtgattgcagaggacaaggcggactatgagtcgcgtcttgcggattcggccgagacagcttttttcgaaggaaacggggcgtgcctgctgcgcatcgaaagcccggaaggaacggtggaggaacggatgttcagcaatgtgttcgaagccgatgggcgtacctttcaggagccgagtccggagatgttcagcttcaacaatcctatcggggcatgccctacttgcgaaggtttcgggaaggtaatggggatcgatgaggatctggtggtaccgaacaagtctctctctgtctatgaagaatgtgtagcttgctggataggggccaagtcgcagatgtggaaggactatttcatccaaaagagtgtgccactgggttttcccgtacacaagccctacaaagagctatccgatatcgaacgcgatatgctgtggcgtggtgtacccacgggagaaccggattacccgaatatcggtatcgacgactatttctctatgctgcagagggatatgcacaagattcagaaccgtgtccggctggcgcattttcgcggcaaagccacctgccccgattgtcgtgggatgcgactcaagccggatgctctgtgcgtgagaataggcggacggaatatatcggagctgacggctctgactgtagaggagacgtcggcatttttcgaggggctacagctatcggaagacgatctacatataagcagacggctgctggaggagataggcaagcggctacgcttcctgctcgaagtggggttggggtatctgacacttgaccgcctgtccaatacgctctcgggtggagagagccagcgcatcagtctggctacgcagctcggcagcagcttggtgggttcgctctacgtgctggacgagccgagtatcggtctgcatcagcgagatacgcatcggcttatcggtgttctgaagcgactgcgcgatctgggcaataccgttgtagtcgtcgagcatgacgaggagacaatccggtcagctgattatatcatcgacatagggccgaaggccggccgccaaggcggcgaagtggtctatgccggcgagtatgaccgcatagacaaggatactccgggctatacggcggcttatctgacgggacgagagaagatcgaactgccacgcctgcgtcgtccatggaactcatatatcgaagttcgggaagcctcgaagcacaatctgaaaggggtgaatgtccgattcccactgcacgtgctcacggtggtgaccggtgtgagcggatcgggaaagagtaccttggtgcgcgatcttttctacgaaggagtaaaaaggattctcgaaggaggcagcacacaagggttagcctgcgagggcattgtcggggacatcaagtctgtccgagacattcagtacgtggatcagaacaatttcggtcgcagcacccgctccaacccggtcacgtacataggtgcttacgatgatattcgcaagctctacagtgcattgccactgtccaaacagatgggataccagccctatttcttcagtttcaataaggaaggaggccgctgcgaggtctgcaaaggagagggcagtatcgtggtggagatgcagttcatggccgatatagtattggagtgtgaagagtgtcatggcaaacgtttccgcaaggagattctcgatgtggagtactgcggcgcgaatatttacgacttgctggagatgacggtcaatcaggccgttgaatttttcaccgatcatccgaaagccagctacacggacaagatcgtggagaagctcgaatgtcttcgagaggtcggactcgggtatctcaaactgggacagagcagcagtacactctccggtggggaaaaccaacgcgtcaagctggctgcatatctgggacaagccaaacccgcacccacgcttttcatcttcgacgaaccgactacgggcttacatatccatgatattcgtaccttgctgcacgcactgagtgctcttatcgacaaagggcattcggtagtggtggtagagcataatatggagataatcaagagtgccgactgtatcatcgacttaggccctgagggtggaggtgccggtggttatttggtcgcaacaggtacgcccgaagaggtgatgcgatgcgatgcctcctatacgggaaagtggttgaaagagatattgggaaacgaacaaagaggttgaacatataattataatagtgtagtatggtaggatcggtattgggttcgattgtaatcggtgctttggccggttatatagccggcaaattgcggcgagggaagtcattgggcttgttgctcaatattctcatcggtttggtgggtggtgtcctgggcggataccttctgaatttgataggcatatataatggtggatctttcttggcgaggcttgctacgtctacgctgggggccatcgttctactgctgctggctgacctcctaagcaaaaagcgttgagattggtcagctatctgtttggcaattggggggtacagcgccggttgcttatattatttgagtgtctaattataaaatgaatgcaaaatgttaggatcgattttaggttccattattatcggtgcattagccggttttattgcaagtaagttacggaagggccgatcgttaggcttattgctcaacattattatcggtttgatcggaggtgttttaggcggcttcgtgttgagtattttaggcttctcggacggtggctctttcttggcaaggcttgccacctccacgctgggtgccatactgctgctggctatagcagacttcttcggcggtaaacgctaaggggattgtgcccacacctgcaagtacaatcttgaaaaggactgcgtacggcaatcctgtaaggagtgcttttgcctctgtccggctgttcctgcttggcaactaatgcctaattccttatatttgagggcacaataaataataatcccttacagacgaaaaaaatagttatggctaacaagataaaagttcttctgacaggagccggcagcacgctgggaagagagattttggctcaactccttacgatgcgcaaagtcttcgagatttccgtttnggatatcaagcgtgggcatacgatggctttcttcgaaaagtataagaaggagattcatattttctacggggactgttccgtacaggataataccgtcgaggcctgtaagggacaggattttgtgattcattgccagagccttgagaaagccaatgcggataagcgtcttcgactggcagaggacgtcaacacgatgggtacgcgctacatcatcgagaatctggaacgcttctccccgggcgcctacctgctctacatttccacggtaggggtatatggcgacagactgaaagctcctatgatcagtgcggacaatatgacctgcccctccatgggcgactacgatgctctgaccaagttgcaagccgaaaagctggtacaggaatccagcctcgaatggacgatctaccgcccgggtattatcctcggacacgattcgtccttgctgaacagctctgtattctgtatgccattggccacacgcttcgagaccgtccatatccgcgatcttgcctctgcctgcgtgaaggcatacgatcacaaagcttctctttgggggcggacatacaatgtgggagggggcgaggcttgtcgcatcgtttactccgactatatccgccgcctgttcaagttgctcggtctcggctacccggagtttccggacagggcgtttgccacacgcaatcgctttggaggatactttgccgatggggatgcattggaagccatcctgcacttccgtcgccatacgatagaagactacttcaaggagttggcagcccaacagcccattctgaaaaagttggccaataagatattcgtcggtgtacagcgcaagagtctggaggggaaaagtgctccgcttcgggcgattaaagagaacgacagagccaaaaagaagtactacttctgacatctgcaccatctcccccgagattatcagcgaaggcggtgtgccaagattgcttgctcagtagcgatctcgtcacatcgctttctgttttttaatagaacatcgctcctaaacttccgtgcgctcgttattctttacagccgtactttcaggagacgggggttagtctctttattttcagtaattttgtcactcgaaaaatataatcaggagggaaacaactactccgcaccctctcgttcggagattccccgatacgaatcaagcatataataatgattacagtcaatgacctgagtgtccaattcggcaagcgaatacttttccaagacgtaaacctcactttcactcccggcaactgctatggtatcatcggtgccaacggtgcaggcaagtccaccatgctgcgcgtgatcagcaagcaactcgatcctacacgcgggacggtaaccttaggcccgggtgagcgcctttcggtgctgagccaggatcactttgctttcgatgagaataccgtgatggataccgtgctgatggggcactccgtcctctgggcgatcatggaggagaagaatgcgctctacgccaaaccggacttcagcgacgaagacggtacacgggtagcagagctggaggacaaattcgccgaaatggaaggctggaatgccgagagcgatgcagccatgttgctgagcggacttggcatcaaagaggatctgcactatatgctgatgaaggatctgagcggaaagcaaaaggtgcgtgtgttactggcgcgcgccctatacggtaagcctgacaacctcttgctcgacgagccaacgaacgacctcgacctcgagaccgtttcatggttggaaaactatctgagcaacttcgaaaacaccgtgctcgtcgtaagccacgaccgccacttcctcgattcggtctgtacccatacggtggacatcgacttcggcaaggtacaacagttcagcggcaactacagcttctggtacgaatccagccagctcgctctgcgccagcaacagcagcagaacaagaaggccgaagagaagcggaaggagttggaagagtttatccgccgcttcagtgcgaacgtagctaagagtaagcaaacgacgagtcgcaagaagatgcttgagaagctcaatatcgaagagattactccctcttcccgtcgctatccgggtattctcttcacacccggtcgcgaacccggcaataagattctggaagtaaaggggctgaccaaaagtatcgaagggcaacttcttttccgtgatctgaacttcaatgtcgaaaaggacgacaagattgtctttatcagccgagatcctcgtgcgatgaccgccctattcagtattatcaacggagagatgacacccgatgaaggtacatacgaatgggggcaaaccattaccacggcttatctgccactggacaattcgggctatttcaatacggatctgaatctcgtggagtggttgtctcagtttgccaaggatacgaacgaagtttttctcaaaggtttcctcggccgtatgctgttcagcggagaggagattctcaaaaaggcatccgtcctctccggaggggagaagatgcgttgtatgatctctaagatgatgatgctggatgccaatacactcgttttggacacgccgaccaaccacctcgacctcgagtccattcaggcattcaacaatacactcaagacttatcgtggcaatgtcctcttcgccagccatgaccatgagtttatccaaacagtggccaaccgtatcatcgaactgacaccgaatgggatcatagacaagatcatggactacgatgactacatcaccgacccgatcgtagcagagatgcgccaaaagctttacggccaataagcgtcttttcggccgcgacgagacgtataagcaaacgagaggagagataaacccgagaagcataatggctgcaacagcctgctttgcttcgggtttgtcacccctctcgctttatctatcgctgtttcttcggatcagtttgcggtccggcttaccaactccctgtacatccgcttatacatcggcagatccacacgaagagcctcggcctcacgcacgacatagccggtcagcgtctccacttccgtggatccgccctgcaagaaatcgctgtgcatagaagaagtactttcgggaggcatcttccgctgtttgtccagtagctgttggactacatcatcggggacttgcccgtatttggcgcggaaaagctcggccacctcttccaataaagacagcagctcgggttcgtgttcggtcaaaatcgagccgatgggtttgtcgaagtaggccgtagcggtagccgttacggagatcatcatgaatttcttcataatgtaccaatcgatatcggtcggattatatgcacgaatacccgcagcagtaagcagttcggcaaggcgcacctcatcatccgtctgctcgggaagtcccgaaccgaaatagaaaagttcgcgatcagcctccagcgtgattaagccgggggcactcttgcgagcagaaatatagacacatcctttccatacgaccgtatcgggcagataggtacgcatgcgttccgctatgtctgcaccgttgagcaagggcaggatcttcgtgttctgcccgatcatcggacgaatttctgctactcccctctccatgtcataatccttggtacaaaagaggatataatcgactgtgccgacttcggcaggattatccgtgacacaggtaggacgagcaaggaaatctcgtgagggagtgaccactcgtagacctcctgccgcgcggatggcttccaaatgtgctccgcgcgctatccaagaaacttcgaggaggccatccgtcgcagctgcgcggagagcaagcatggctccgtagtagccacctactccaccgagtccgaatacggcgattttgattggttgttggttcatttgcttctttagtttattgagtatttgcgaccggaactgtttgcagctgtctgccgccatcggtatgaccggtaaactccggtgcataggcactgctcacggtagcgatacctgaggcataagctcccgaacgaaccacaacggtggagtattggagcttgtaggatcctcttaccagacgatcgaaatagaaacgcgtactgctatcctttatttctctgtagtagaacgttccggctgcataatcataacccgaaagttggccgataggttccaccgcagccgttcgcttgtccgtcaggacaatgaagtccatatcgcgatcgagcgtaatggtcagttgcgtcacgagccgtttaccgacttccagccgatcgccctctcggagaggtacgagcgttagcttgccatctatcacctgctcggagaaaagatgcttctctaccgacaagccattacccgtagctacgagatccgccgccggcgcatcgtattccgccaagaaggaagcccaagcaaatccttttccggaacgagcaagctctgcacttagtttgccttgcggaagatcttccaccgtaacgatccgactttcgcctgcaccggcaaatgtacctgacaaggcaggtacaggagcccggacagacacagtggcttctaccattcgatcttttcctgcacctaacaagagagcatatatcgcatcggaagaagccggcagactcggccaaagctgagttcttttctgattgaggagccacatctgcaagccttcgatatgagagctgtcctgagacgtaccgatacgagcgaaggcctcgatcgcttccgtctgcataccatagcgacggtcgcaccaataatatccgcctgaaggcagcgcaaagtgcgcaccctgatccggtgtgcggatgatatgctcacggatagaacggaggaaatcatcggccagtgccttacgccctacaccgtggagtacgatggcagctcgcggcatatccaaaatggaaatatgcggaagggatcggccgagaatatcgaggaaatacatgcgggcagcatggccacgagagcttgggttgcgactgtcgatcgtaagcagatagagatagttgagtgctcgttccggcagtattttgtacttactcttggttttcttttcgtattccttcattctatccatcagtcgtgaggcagcatcatcgagagcattccaccccatacgcttcaccgcctgaaactccttatgctccggtgcagcggtaagagcggagagacgtaccagcatcgtcatcacatagtccgtcagataatcgttggaagacatctcaggatgccaagcccacgaaccgtcagacttttgcagccttttcagtttgtcagtcagcatctgctccgtccatgtcagacgatccgaagccacgagagcctgcaaacgctgacgattgttctgttcggccagcatctccgcgcgccaaggcaattcgtccgaggacaagggcgatttttgtaaagcgagtgtatccaagggctgcgccaagtagtgccgcaaactctcacccaaagcaggagtatgcagcaagcgacccgaaacaagggcagcagcaatactattggcataaagagccgaagccaccgaaacggcatcttcctcgtgtacatcagtcatcacgggcaaggcctgtacggccacccaaagcggattgctcaccacctgaagtgccattgtacccatagccggtctgccgctgcgatggggaaatagactatccagatccaccgtttgggactgtccgccgtagagaatcaacggtatggtctccaccactcgctccgtagccggcagttgcacgatcgagtgttgctctccatcgctgaagtcatggctttcggctaacaaacgtacacccagagcatcatatccggagacaggatcgagcggaaacgacaccgtaaccgtaccaccggcttccaccgagaacggaagcctctcgccgcccaatagcttgtcggtagcagggtcgaacagttccatacggacgaagccctgctgcatcgtctcgctcccgttccgaatcgaagccgaagccgtacccttgtcacccattctcaggaatcgtggcaaattgggtgtaagcataaagtctttccgcacctccacgctttcgtctttcatgcccaaccgcatatccttcgtatgtgcaaagaggagcaggtgccagcgcgtcagtgtctcgggcagagtgaaagaccaagaaacttcgccccgttcatcggtcagcaatgccggctcaaagaatgcagtctcagcgaaattggtacgcacggaggattcttgaatcccggattccttcgattcgggttctgcttcatttaccgcatctgcccgagcagctttctcctccatcgggaaagcatcgaccgatttggcttccggaactccatatcccacaaatatcatcggtccatcataataataatccgaagacacatatctataaccggtagcagaccagaggcagagttggggagttttgaaaacagggtgtttgaacccgacttgcacgtaagaatcctccacaaaccccgacactcgatacccgctattcgggaaagacaacctaaccaaagaagccggagagtcggcaaaagagaagaatcgggaggagaaaacagaactgtgcacgatcttatcaagagcagcatcgtacatccaagcagccatcatggtatgagagagcggtttgccctccgcatcggcgagacggagcttccatgtctctttctcaccaggtcggagcttgtcgcggaaagtactccacgacatctttatctctcgcttgggcagtctgcgttccagatctatgcttcgactatacagcctccctccatatacataatagagagaaacattcatactctccggcaacggagctgccggaagcatcggcactatctcgacgatctcacccggccggcaagcgatcatcttcctttcgatgaatcggcctgcctgagtcaggtcgtagaacagatacaactcctgagcatccgcatccttgggagtagcaccgaccaggatgcgggcagggcggtgactgtcgtatttctcctccgccacatatgtccaaaggccttgggagggattcgacaactgacgatctttcggacggaagagataaacgtccttcgtaacaaagtcggaatcctctccgccactctcgccaaaacgcaatcggtactgtcccgaaggcaacttgccccattcggccggagcaggcgtcaccacacctgaagctgcggtataaagccgaccgatacgttcattgtcggcatcgcacaggaagtaggcgatggatccctccaccgtctgtccggaagtattggtaagggagaatgtcagatccggcagagaggtggcaagccagttgtcttcgttggcacgaatgtatttacccacttcgacgtccaccctcttgggttcttttcccacgggtattcggagtacggcggcctgcgtctcgccaccgggggcggtcacatccgccgatagcgtgtagaggcagtaggaatagtcttcccgtccttccggccgagacagcgaaacaggtatgacgaagtaccccgattcatctaccactgcctcaccggtctgtacgaccctatcggccacaggtctaccccaccaccgacgcgtatagggggtcaggctcagccgatagttcaccgtagctcctcgcataccgattccggtaaaggtcttggcttcgcctcgtatgcggagggtgtcgcccatagcatatgcagcgtcgggactccggaggccgacttcgaatgtaggccgcttgtactcttccacactaaagggatatgtatcccctcccactcgtagtccgaacaggccattcaagatccctgtcgggaggtcgaagctaccggagaaacgtcccatctcatctgcctggcatagcagccgaccgatctccttggagttagcatcttccagcacgacttcaacttccgatccaccgatggcgcgtgcgtcctccacggcataacctatccggtcgcactggccgaagaaatggactttctgcccgggacgatagatggcgcgatccgtggagacgatatacttgcgctcattcttcttggaaagatccacctgatcctgtttgtaggtataggcagaaacaacgggatacgagcggtcaccgtcggtataggggaagaagcgattgtagcttttcggcagatcgatccgaccataccgatccgtaggagaaagggtatgaaccgatcggtctatagaataacgcatggaagcatccaccgatgcgccttccacgggcttgcccgtcagcgcatcgagtacctgcacacccggcatggcctgctgagcgaggaagaagagatccgatacatggagcagactgtattggggcaccggcttggtcttttcgagtacacactgctctgccgaggctttcaccagatagacccccttgggcagatccggaagtgtacagcggatcgaatccattttcatatcggccggccctgtgtccgaatgctttccggtccaaaaaggtgttcctttcgcatacaagtgcagatccttcctgccttatatcagcagcttgcgagccattcatatccagccagtncagactgatgaggacggagccgacattgcgcgatgcgatccgcatgctcttcggnaggcgtgtatgcagccggaggggatagtcgcacttgacgaaagaagccaaaatgcgcgaagcccgagagcttttcagcaggttgatacgaggaagcctccggatacttggacagatanctgttgcacaggtcgagagcagatacatactcctcttcatcacaataggcattcactcgtctgtccaccataccgattacatcggggagatccgaatacgctgctatcagctcgtccatccgacgataggaagctgcatcatcgagctttcgacaccgctt

SEQ ID NO: 1091 - DNA (genomic), 2135 bp, PORYPHYROMONAS GINGIVALIS; double-stranded, circular
  misc_feature 1...2135
  hypothetical: NO
  anti-sense: UNKNOWN
cgtgtgaaactttttggacgatttcagtcgtcaatgccgaatagtcaggaagaaatggaaccgtcttgtagaagcactccgctccggatactcaatgcaggtaaatagcccagagagcctgcagtttgcggattcttcgataaaataagcacttttgtcatactgaaaacgttgtgccacaggccaacagaccgaccactttcggtaataatagaagttatagaagcatgaatttattctcgaatcttctgtttcgcttcgatgtacgccgtctgtccgaagatacgctcaaagctatctattctttggaagaagacggtctgcccgtcaatgcagaccgactggcagccctgaccgggctgaagataagcaaccaacagtatatactcgatctgctgcacaaacaaggctactgcctgcctccggactcgcatctgaccgaaagcggacggaaatatgcgctcaaggtgattcgccgccacaggcttttggaaaagtatctgtccgaacactccggctatgaacccagcgaatggcatacacaagcctgcaaggaggagcactatctgtccgatgaagagcaggagcggatagcagtccgcctgggcaatccgcttttcgacccgcatggcgatcccatcccgacggaagagggcgaagtgcaatccgtggaaggagtacatgccgacgaactgccggacgactcgtatgtgagagtgatccacatcgaagatgagcctgccgacctgtatcggcagatagaaaccatcggtttcttccgcggtgccgtatttcatcttctgcgtaccgatacggatggagtgcacctttctttcgagggggagcagttcttgttaccacaggaggctgcacataatctgaccgtaatgccttgtacggacaaaggcatgatagatttggcacggaagaccgtcaagctcactacacttcgtcagggcgaagaagctacgatagccggcatcagcaaggcctgtcggggggccaatcgtagacggctattggacttaggatttgtacgcggtagccgaatcgccatagatctgaccagccccttgggcaatccgacagcttatgtggtcagaggaacggccatcgccctgcgacgcgatcaagctcgttatatccttatatacaggtaaaagacctaaacgctcagaccaacttcgaatcgaatgatgaaaaagagtgctaccacctcttcagcctgcaacggctgccccgcacacagcggaaataaactccggcgcatgggcaccgatgcggagcgatacgacttcaccatcgcccttgccggcaatcccaatacaggcaagagtacggtattcaatgccctgaccgggctcaaacaacatacgggcaactggcccgggaaaacggtagagaaagccgaaggtgcattctcgtatgccggctcttcatacaagatagtggatcttccgggcacctattctctcctttctacctccgaggatgaggagatcgctcgcgacttcattctcttcggcaagcccgatgttaccctcatcgtggcagatgctacccgactggagcggaatatgaatctgatcctgcaaatcctcgaaataacggatcgtgccgtcctatgtgccaatctaatggacgaagccgaacggaacggcgtagagatcgacctgagaggtctctcgcgcaggctgggcatccctgtcgtaggagccagtgcacgttcgggagagggcatatccgatctcctgtcggccctgtccgaggtggcccaagggatatatcgctgtactccgcatcgactgacaagtatcggtactgaaatagatacgcggatcgattctttggccgaatccatccggctctttcatcccgatacgcccaatagcagatggttggcccttcgccttacggagggagatcgacgggtggagaatatcctctatgccgataacgaagctccggcagagaagctgaaaaaagagagtggacgagtttcgccgcaacttcggcgaagacctgcatgaccagctctccgaagcactctattccgatgccggaaaaatatgcccagaggtgatcactcaggccaacaaacgcgggagaactccacttggacatcaagatagatc

SEQ ID NO: 1092 - DNA (genomic), 7685 bp, PORYPHYROMONAS GINGIVALIS; double-stranded, circular
  misc_feature 1...7685
  hypothetical: NO
  anti-sense: UNKNOWN
caacgaataataaacgggtattgcgtttcattttgctgtttcgccttttgtttttctctttccgaatacaagtccaaaggtagtaataatagttgtcgcaaaagagtccgttttccgcccttacgagcttttctcttcggaagactccgctttgctcgtagagagcatgccgcatgccgcgaatatatcttcccctcgcgatgcacggatggtacaggtaaagccatgcgattccatacgtttgcggaaagcctccatgcgagcggtatccgaagaacggagcgatacggcagggattttgtggaagcggatcagattgatcctgcaggggatgccgcggaggatagcggccagttcgtcggcatggcgcatatcgtcgttcagaccatcgaagacgatgtattcgaacgacactcgtcgttgtccgctgaaatcgtaagccctgatccggtcgagcgtctgcataatggggaaagccttttcacccggcatcagtttcctcctttcttccgggaaggggctatgcaggctgactgccagatggcaccggctctctgcgaggaaacgctccaatcctttggcaccgatcgtagatactgttatgcgcttcggactccagcccatgccccacggctctgtcagggcttcgatactgcgaagcacttcgtccgtattgtcgagcggttcgcccatgcccatatagacgagattggtcagctcggctgcttcatccacggagaaaatctggttcaggatctcggctgcagagagattgccgttccatccctgtttgccggtcatgcagaagaggcagtccattttgcaaccgacctgagacgagatacagagcgtagccctgtcgccctcagggataagtacagattccacgaaacgcccttctcctacggggaagagatacttcttggttccgtccaccgaacattgtacatccgaccacgggtagcgtccgagatcgtagatctctgccaacttctgccgattggcctgcgatatgttcgtcatctcggcaaaatcggtagcacgccgcacatagatccattcggctagttgcttgcctgcaaaccgcggcatacccatccggagagccactgtggtcagctcttcgagcgacatacccaaaagcacaactttcttttcagtctctgtctgttgcttcacttcaccactcaattatataatgtaaccacaagaaagagcttcatcttcttctttcccatccgtcagggattcggcagcgatcggaccgatcctcggatgtactcctctccatacaaaagtaatatatcccgtactaagccctcccatttcgctcttgataggatcgatacgatgaaagagatgcgtgcgcatgcaaggagttggtgtcgctgctccccgagcttgatctccggatagcaggggcttaagaaaaggaaacgggtgagatcgtgaaagatgaaacacgaaccaaaaaacgccgggttgcggttcgtattttctgaaaaagtggcgtgagatctttttcgctgtggcgcgtaaattttttacttcccgaaccaaaacgaaaaaattctcgcgccacgtttttgggagcatggaatgagaaaattttgggctgtaaactcccgaacgatgaataaagtgatctgtgccgaaaaacttcctgtgagcaggggggcgaaagattgggctctccgcacagagcgaataagagaggggctgaaagccactgcggatctcagcccctctctccttatgatagtattcgtcaggcgtctctttattcgagcctatgtgcgacagtgaagtgtcagacgatagccgctacaatggttgctgcatccgccggcaacatttgctgctctcccgtcagcatgtttttcagattcacttgcccggccgctcgttcgttttctccgacgagtgccacgtatggaatgttggctgcattggcatagctcatctgtttcttgatcttggcaggttcgggatacagctctgtgcgaaggccttgctccctgagcttttggatcagcgggagcaggctgtcggcatcctcttcgctgaaattgacaaagagcagctgcgtaccggtcagcttctcggcagggaagaggtcgagctgcatcatcacatcatagatacggtctgcaccgaaagaaatgcccacaccggacattccctccagaccgaatatgccggtgaggttgtcgtagcgaccaccgccggtaatgctgcccatctcggcgtcgagtgctttcacttcgagaatggctcctgtataataggaaaggccacgagccagagaaatatcgaccatcagttcggaatggagctgcacgcgctccactttgtccaagatataggtcagctcttctatccctttcagccccgtttcggaggaggcaagagccgatttgagccggtcgagcttctcccgattgtcccctttcatctcgataaaaggacgcaagcgttcgatagcctcttcgccgaagcctttggtgcgcagctcgtcgttcaccttgtcgaggccgatcttgtcgagtttgtctatcgccaccgtaatgtccgtcagcctgtcggcttcatctaccacttcggcgataccggagaggatcttgcggttgttcagcaggatacgagtcctgatacccaatctgcgaaagacttcgctgatgatctggatgagttctacctcattcatgagcgaatccgagccgatgacgtctccatcgcactggtaaaactcgcgatagcgacccttctgcggtctatcggcacgccatacgggttgaatctgataccgtttgaaagggaaattgatctcgttgcgatgcatcaccacgtagcgagcaaagggaactgtcaggtcgtatcgaagccctttctcacaagctttggctgcaaaccgcagagaatttttctctgccagttcctccgcacagaagtctgccagcacgtcgccggagttgagcaccttgaagagcaggcggtctccctcctctccgtacttgcccatcagcgtggagagcatctccatcgtcggagtttctatttggttgaatccgaagagttcgtacacctcgcgtatggtgtcgaatatgtagttgcgccggctcatttcgaccggactgaaatcgcgcattcctttgggtatagaaggcttttgcattacgtatgtattagttggtgaatgataggttacaaaaacagagagaggagagtccccatatcaataatcgcggataagctccagcagagtggtggcatatcggtttttctcgtcggccggatattccgtacggctcagctccacccattcgctcatgtccaattcaggaaaaaaagtgtcggcttcgggaaagtcggcatgcacgcgtgtcagatagattttgtccgtgtagggcagcatctgctcatatacttgtgctccgccgatgacaaaggcctctgcctcttcgcccaccagctccaatgccacttcgggcgaagctgcccattcggctcccggaaaatcctgctgcatcctgcttaggacgatattgcgtctgttcggcaaagcacctttgggcagggagcggaatgtgcggctacccatgataatgctatgccctgtggtcatttccttgaatcgtttgagatcggccggcagatgccagaggaggtcatttttgtatccgatagccccattctcggctatggcaacaacgattgaaatcatattggataggtgaggaaaaactgaatatcggtggaaaacattccgtcagactgctacaacgcccgcaatgtgcggatgcggatcatacccttcgagtcggaagtcttcgtatcggaagtcgaagagatcggacacctccggattcagtaccattcggggcaacgctctcggctcacgactcagttgtagctgtacctgttcgaggtggttaagatagatatgggcgtcgcccagtgtatgtacgaatcgcccgggtttcagccctgtgacatgagcgatcatttgtagcaggagtgcatacgaagctatgttgaacggtatgcccagaaaagaatcggcactgcgctgatagagttgcaggctcagccggccgtcagcgacatagaactgcatgaaacagtggcatggaggcagatgcatatcggcaagctggcctacattccacgagcatacgataatgcgccggctgtccggttcttcgcgcagctggcgcagcacctcctgcatttggtctatatgccctccccgatagtccggccaactgcgccactggtagccatatataggtcccaaatcgccgttctcatcagcccattcgttccaaatgcgtacgccatgttcctgcaggtaatgcacgttcgtgtcacctctgaggaaccaaagcagttcgtatataatggacttcaagtgcaatcgcttggtcgtaagcaagggaaatccctcttcaaggtcaaagcacatctgatggccgaatacgctgatcgtacccgtacccgtgcggtcttcttttcgtactccctcgtcgaggatgcggcgaagcagatccaaatactgtttcataccacgcaaatatacgtatttcttgtaggcaaatggatttttgacaccacagcagactcattataagagacctttgaaaaataaggagatggagtaaagaggagttcttggcaaaaaaggagcgagggaaaggggtggcagtaaggagtgaaagtagttgtaaatccccccttgaggagctgcttgcacgagctcctcaaggggggttatgccttatcctagagatgaggacataattatccccggggtcctgtataaattaaaggcgatgctttcaagaatgttttgagtatgggtcttggcaagtccccggtatcgacatcgtccgccatgaaaccaccggcgaatactgccaaaggtgcgttcgatggtgctccgtatccgactgattgctttgtttcgttgcttctcttcctcggtcaatgccctgttgcgttgtgccttgtgcatgatgccgtcttgaaggtgatgggtttgcaggtaggaacgattttccccgcaagcatatcctttgtccgccaagacggctgagccttgaggtatgtttgcaccctgcaatagcgcaataaactccttcgtgtcactgcggttcgctgcagtcgttatcaccttttgaacaatgccttgaacattggtcaagacaatgctttttgtatccgtagtgataacgcttttgtttgtaacccaacgggcttcttcatccgtccctttacgctgacggacaacctgtttttgataatcctcctctgcctctttttcctcctcgctccgattgtcttctctgtcgtctgcgacttcaatcgtaatgcttccgtttgggtttatgcggcgtctccacaaggcttgcatcgacaagcaccccttccctgaccgaaatgtgatggcgggaaagttgtttgttaaactgcgccaatagtttgtccatgaccccaactctgtcagtgccgaacgaaatcgactgatggtgctgtggtcgggagatacctcttccattagccccaagaatcgggaaaaggtgattgaatcattgatgcgctcctccaaagcacaatcactgaggttgtaccatgtctccaaaagcaacatcttgaataagagaatcacgtcataagccggggcgccgatggcattttgtcgcttggtgtatttcttgttgatcagcgtcctgatcggacgccaatcgataagcctctcaacctgattgaggaagtcgttttgtgctttgcgataacgctttgaaaggagtgcgtctgcaaatgttacatgctcatcggtattcttggattggtatgccatgggaggaatattatgctgtttttaatactcaaatatacaaaataactccctactatacaatcaattaacaagcaaaatacacaccaatcgccatgcaaaggtctcattgttcgccgagaaatctgcatttcggctctgcaatgcagattgtccggcggacagctcccccttcgccgaaaacgatcataatcctatacagagaggaatcctccaaacggcttcgatgcaacggcaaacaattcctctgagttttataagtgtttcggggatcttttttctgctgggttttgaaatctacagatactttatgatgctgattgaggtaggtcccaactttatagagtgatagaaccgatttttctgaaagtatcgaaaaaaatagaaaaagagatcgcatctcacaatcattaaagaattggaggtgcgatctctcttttttccgtacagtacgataattattcccttaaagctcccttgtctaaaggaggagggagagtcgccggattatttcactttcgtaagggcttcgtccacggcttcgagtataggcaataccgatatgggagaacccacggcttgtttcatccagtactgcggcaccagtcgtccctgtacgagcatgcgcttcagctccacggccaaggatttgcccttgatgtactgttcgatctgaaagtcgatgatatgccccatcggataattgggcaggtagagcggataattgatcatatgcgaatagatgcccagaatggtctcgtccttttctccgagaatgccggcgtagtacttgttccaaacggttttggccgcgtccatgaccgcgagtttcagctcgtgtgcatcggcttcaggatgcgtgtacatccattcccaaacggccatgtctacgagggatacgcccatgatctcgtagcaattccaaaagttggtcagagcctcgttgtactccttctgtgcatcgggcttgctgacaccgaggagttcgagatcccgcttctggaagaggaaagcgacggcttcggtgaaggatgtgttcggcacaccgttgagcatgtagtagtccacatcgttcatcgtgatggtttgctccgtattgtgtccgaattcgtgtacggctatattgtatcctttgtagtccatccccgtatcggcgatacgtgtgcgcaggcgagcaaagtcattgcgcatcatcgagcctgcagcatggccggcacctcgcgaaggatccaccatcaccaaagaagctatccgctcggcatctttgctttcgaatcccagcttgcgcaggatgttcggcagatcggctttgagtgcttcgggtgtaggatatttagctgcggtgattttgtccaattcgctctctggcatacccgactgcgagcgaaagccgttgtaccagatgtcgaacggctccaacgggcgtcccaatcgtttgctgatcagttgagccaccttctttacctgtggagaggagagcagtgtttcgaatagctgtttgacgtcttcttgcggaatctccatctctccctcgaatgcacgcaggatctggttcggctgatgcggcatgtatgcatcctgtgcttgcatcgcacggaaattggccaggaaatattcatatcgcgtatcgggttcggcatgacctcggatagcagtgccggccgggtcgtagagcatattgctcaggggatcccattgaaagtccgtcttgtcgattacttcgcgtgggatactttggtcgatgatcctcttgatgatcgcgtatatcattcgctgcttttccaatccgcctttcgtgtccgcatagttgcttttgatctcatcttgg

SEQ ID NO: 1093 - DNA (genomic), 4597 bp, PORYPHYROMONAS GINGIVALIS; double-stranded, circular
  misc_feature 1...4597
  hypothetical: NO
  anti-sense: UNKNOWN
caataagatgaccggactcgaatgtcgcagccaacaaagagctgaaaatactccactgcaacaacaatcagctgaccgccctcaatctctcggccaataccaagctgacgactctaagcttcttcaacaacgagctgacaaatatcgatctctccgacaacacggctttggagtggcttttctgcaacggcaataagctgacgaagttagatgtatctgccaacgccaatctgatagcactgcaatgcagcaacaaccagctgactgctctggatctgtcaaaaacgccgaaactgacaacgttgaattgctactccaaccggatcaaagataccgccatgcgtgcattgatcgaaagcctgcctacgatcactgaaggagaaggcaggttcgttccttacaacgacgatgaaggaggagaagaggagaacgtgtgtacaaccgaacacgtggaaatggccaaggccaagaattggaaggtacttacctcgtggggagagcctttccccggaataacggctttgatttccatcgaaggtgagagcgaatattccgtatatgctcaagatggcatcctctacctctccggtatggagcagggcttgcccgttcaggtatataccgtgggaggaagcatgatgtactcatctgtcgcttccggatcagccatggaaatacagctcccgagaggtgcagcctatgtagtacgtatcggcagccatgcgatcaaaaccgcgatgccgtaaacgaattttacccaacgatcaagggctgtgccaatggatgatattccgagaggtacagccctttctttttcaccatgaaccggtgacaatgtgcttaggccgaggaagagagagattcggtaagcaattcgcccaatagtgaacgaaggacagccatcgagggaaggacaagcgatgcaccggcatcccacaaatcggcatcgggcaagcaacctgtattcactgcaatggtaaagataccggcatcgacagcagcacgaactcccagcggagcattctctaccacaaaagcctcggaaggcgacatccccacgcactccaatgccttgagataaggctccggatgaggttttccacggtgtacatcggcacctgtcaccatgtttgcaggactgaaattgtcgccataacttctttgcaaacgctgcaatatatcagtctgggacgaacctgtcaccagcatgatacgcaagccccggtcacaaacgtccgacaccagagccggagcatcgtcgatcacgtttccggaattgtacaaagcgaagagttggctcttgcgcccgtacatatcggctatttctttttctgtcggcagtcgtccgtatccccgttcgaacaggatcttgatggtatcgctacccttctgtccttcccagcgatagaaatccagcggctccgcagcgataccgcattctccggcagcctccacccaactccgtgcatgtgccggcatggaatcgaacagcactccgtccatatcgaaaaagcacgaacggagaggggcatgccggtatgccttctctgtgcggaaagcctgtaatgcctccgttatgttattgtagtccatcgactcttttttctccattagcttatgacactccagtcttcctccttggggaaaagtttgttcagacgaagagccagcatttgattgtcgggatggcgaagttcggggtcgcgctccagtagttgctccgctatacttcgggaaagagctatcagctccgtatctcgtgcgggattggctatccgaaggctgatctgacgaccgctctggcgcgtaccctccaagtcgccgaaaccacgaaggcgcatatcttcctctgctatttcgaatccatcgttcgtctccaccatcacctgaatacgccgacgcgaatcctctcctgttttcgttcccgtgatcaggatgcaatagctttgctctcctccgcggcctacacgtcctctaagctggtgtagctgcgacaggccgaaacgatcggcattctccactaccatcaccgtagcattggggacattcactccgacttcgataaccgtcgtagccaacaagatacgggagcgaccgctgacgaagtccgccatacgtgcctccttttccttggctttcatcttgccgtgcaccatcgtcacgccctcatcggggaaaatggaagagaacagctcgaagccatcttcaagattcttcagatcggtcgtctccgacccctcgatcatcggatacaccacatacacctgccggcctgcggcaagctgagatcgcaggaaacgaaagaccggagccatatcgttgtcgaagtggtggagcgtctgtatgggcttacggccgggaggcaattcgtcaatgatggaaatatccagatcgccgtacaacgtcatggccaatgtacgaggtatgggggtggcactcataatcagaatatggggcagagtgtcgaggttcttttcccacaggcgggctcgctgctgtacgccgaatcggtgctgctcgtctatgactgccattcccaaacgacgaaaggccactccctgttccaatagggcatgcgtgccgacgacgatggagagcgagccatcggccagacgcggaagcaagcgttcccgctgacgtgcggtacagcttccgatgagcaaaccgacttctatgccaagcggtcgcaacagctcggacagggtatgatgatgctgtctggcgagaatttcggtcggagccatcaggcaagcctgacagccattgtccagagccaacagcatggacagcaaggctaccaaagttttaccgctacccacatcgccctgcaccagtcggttcatttgatgtccgctgagggtatcctgccggatctcccgtatcacccttttctgcgcaccggtcagttcgaaaggcagatgttccttgtagaatgtattgaataaggctcccacttgagcaaaaacaattccctgaaaacgcgctttacgctccagcttgctgccgatcagatgcagctgcacatagaacagctcttcgaacttgagtcttgtacgggcagcttccagctgtgccaccccctgagggaaatgaatctgtctgatggcctcctgataggagacgaacccataagacgaaaggatgtaaggcggcagtgtctccgtcagtgtggctgatacctgattgaggagtacgtacaggagttgctggagctgtttgctgcccagccccatactcttcatgcgctctgtggtgtgataaatcggagtcagtccgccggctacctgctctgccttctcctccgcatctatttcgggatgtgctatgttatagccggaagcgaagaaaactggcttgccgaaaacgatatatcgccgtccttcctgcagtttgtcgcgtatgtacttgatacccttgaaccaaaccagctctatgcttcccgtaccgtccgagaaagtagccgtcagccgcttgcgccgtccttcgcccacctcggagaagttgcgaaggacaccgcgcagctggatatagggcatatcggagcgtatctcccgtatggcataaaatcgactcctatcgacatagcgaaagggaaaataatggagaagatccagataggtacgtacttctatttcctccttcagtacttccgcccgcttcggccctacgccggtcaggtaagtgattttggtcgataggatgtccatctgccagaagatagggtatcgggtgcgttaatgggctgcggattacttctccgacaagcgttgctgccaacgccatgcactcagcagtgtgtcttccaacgactccaaagctttccaacccaacacctcattggctttcttcggctcggcccatacctgttcgatatcgccttcgcgccttcctactatccgatgaggaacagcaacgcctgtcacccgttcgaaggtacggataagctccagcacgctcacgcccctacccgtacctatattaaagacttcgagcgaatcgctcgctttctcttcattcagcatccgttcgatggcagccacatgcgctttggccaaatccaccacatagatatagtcccggatacaagagccgtcgggcgtgtcgtagtcatcgccgaagacgctcagttcggctctgatgcctgctgccgtttgagtcaaataagggatcagattctgtggcactccgttaggaagctctccgatatgcgccgtggggtgtgccccgatcggattgaagtagcgcagaagtatagccttgtaccctgctccggcatggatagcatcgcggataatctcctcgttgatttgcttcgtattgccatagggagagagagcttcctgtatcggagcctcttccgttacgggcaatacctccggctgtccgtacaccgtacaggatgaggaaaatacgatcccacgagtgccgaatcgctccatcagttcgaggatattcagcagtgagaggatattgttcctgtagtacaaaagcggcttctgcaccgattcgcctacgggcttacttgcagcaaaatgaatgacgcctgctatatcgggattgcgccgtaaagacgcgcttcatcggcttccggatcatt

SEQ ID NO: 1094 - DNA (genomic), 412 bp, PORYPHYROMONAS GINGIVALIS; double-stranded, circular
  misc_feature 1...412
  hypothetical: NO
  anti-sense: UNKNOWN
tattttttggggcgatattatcctgaaagactttaatgagatagacaaacacctcgtatcggccaaagccttatacagcaatctgaaagactttcgggagatggagaacgatttctcatttttgagcgaaagacaggtagcagccattcgcagtttttgggaatccttttctccagcaagcggccaaatggagaatggatgtcagcagagttttctggatttctggaagctattgtccccgctttacattcggttcaaccaacgtcttgcagaccaaggcaacggataccatgggatgatccttcgccatacagttgatcgcctccggcaaagagaaacatcggtacgagagctgctctcatctgcagacagaggggggaatgcacatcctgataaatatgtctttggcggg

SEQ ID NO: 1095 - DNA (genomic), 3717 bp, PORYPHYROMONAS GINGIVALIS; double-stranded, circular
  misc_feature 1...3717
  hypothetical: NO
  anti-sense: UNKNOWN
acctgctctataatacggcctatttcctgtggggagataagcgatggagtccctcctccgaagtaaagagtgccgatcgtatcggtgacttcggcacgacgaatactcatctcggcgatcagtgcctgtatatactccgaacgaagcgcgctgttcgtctgcgaatagaagtcgcaatacgagcagcgcgtggcacagaaaggaatatgaatgtatagtcccgtcacttgatctccatgcttgagggagcggatacggggccggccacattcattttgttgatggcttggagacgtacttctatcccgcgtggctcccactgttagctccttgggcagcaggtaggagttgtcttcgatgcggtcagccaccagcctgtcctgcatccggccggaggtgtcgaatcttctgaggaagaggcggtagtatactacagctgtttctccggcagctttgtcccaactcacagcgattttgccatctgtccggcgtgtcagccgaggaatttctgcttttatgggagcggcaaaacccttgcgatgtatggggatgggtaccacgtcttcggcaaatcgttcgcgaatgatctgcggtatgccattgctttcgtggcgcaactgatcttctcggaagaggcagacgccggcgaatcctatgtgacgggcggagtcgatttgctctccgatgacttgagccggccactgactgttgtctacgacccgataggtggctaatcccgggataatcggcaggtcgggtagctgcgctttccaatcttcaaggaaaggataaaataggtcgtcacggtagtagagcatcggtaccagaaagtccacacttccttcttgtgcccagacaacgggatcctggtgtaccccttcgtaggctgtccagtcaccgccacgtttgccggcgagctttctcagacggccgatggtagctacgcttacctgtacccacggagtcttttccgtagcggctcggtgaacgtccgccatgaggtcggacaggtttcgccgccgccatgctgccggatccatattgcctccatactgtttataggtggcagcatcatcgaagattttggctttttccggatagcgcatgtagtcgaggtgaatgccatcgacggggtatttctctacgatctcacgaacgagggatgcgaagtaggctcttgcttcgggtacgcccggattgaggtaccatagattattgtgccgtacacaccattcgggatgacggcttttgaccgattcgcctttcagcgaacgtatgtgtttatccggtcctaagggggtgacaatgagccacgcatggaaagtcagacctcgcttgtggcactcttttagggcaaactccagcgggtcgtagtccggcttgcctgtcccggtgaatatggtcgattggggttctatctcagaggggtaaatgacatctccgcgatgacgcacctgaaagaatacagtgttgaatttctcacgcttgagcctgtccagaatacggcagagttcttctctctgttttcgcagtccttcggccgtaggagcggagcgttgtggccagtcgagtccatatatggtggtcagccataccccacgcatttcctctctcaccggactgacccacggttcgatgacaggagctgcaatcaccgtgtccggaagaggcttcactgtggggggagacggggcgacctttttagtgccacagccggcaaagaggagagcggcaatactgacgaaccaccctgtgagaccgctaatcttcatatttgatgttatcgatcaggcgaacctctccgcaatataccgtaatacaacctacggcatggtcggtgtcttgccagttgtcgatcttttgtaaggaattcccgtctactatttcgaagtactccacttgcagatgaggcagggcattaaggctttccgtcacccatcgcgtaacagcttcgggtgtatgtgccggacggagtgtgcggctttgtccgaggatgcgagcgatggatggggctatggcacgctcttcggtgccgaggcggacgttgcggctactgagtgcaagcccgtcctcttcacggatgataggacaggccacgatcgtaacgggtaagccaagcaggttcaccatgctgcggataacggcgatttgctggaaatccttttctccgaaatatgccttgtccggctccaccatcatgaagagtttgcttaccacctgcgccacgccattgaagtgtccggggcgatgcttgccttccatcacttccgccacactgcccagatcgaatacgcgagtgtccggttcgggatatacctcttctacggagggcatgaatacggcatgacaagcggcttccgccaagactgctgcatcggcttccggtgtgcggggataacattccagatcgcgtttgtcgttgaattgtgtaggattgacaaatacgcttgccacgcaaatgtcgcattcggctacggcacggtggatcagactgatgtgtcctcggtgcaaagctcccatcgtggggacgaggccgatggttttcccttcggcacgagcatgtgccacaaagttcttgagtgaagcgacggtgttgaatatttccataacggcattatttgttcttctgttatgactttggtgataaatccctcggggataattttttgcaaaggaacagattatttgcggattgccggtttgatagagagacttttagtggtactttagccttggcttatcgttatgccctcaaaaatcaattcgatgaaaaaagtattatctctcttaatggtattgggtgctatcatgttttactgccatgatgcccagtcgcaaataagtattcgtgcttttgagttcaacgccaacttcaatcattcgccggccggcaccggtgccggcagtgatctgctcggtacggatctgaatctgcggatgcaactgcatcatgccgaactacccgatgccttggatttctatgtcggcatccagcggagagagagcttttggcagaatggaaatgggccgatcatctatgtgaatcatcccgatgggacaaaagagaaattgaacttcggcactgctgaaggcccgtttcaaagcgatgcatacagcaagttgctgatttgcttcggcccggcatataccctgtctataggcaagcgtttcggttggaccaatgagctgatgttcctctttgctcctataccttggagtcggcttccctatcattcgatcggatacagggcttcgggtagatcatatgcgaggaaagagcacaagccattcagatacaatggcttttcacccggtatagggatcaatagctgtctctggtggaaagtctctgtcagagacgaatacatcttccgtatcggtctgaacgttgggtatgaatatatggatcagctctacgcataccgccacttcaaagtaaatgaagaaaaacctctttcctccctctcccaaaggctgaagcacatcggccacatcggtctgaactttgccctcagtctgaactgaggttatctcaataaaattcaggtacggataggtttcgatagccttggtaagaacgtcggtgaagaggagaaggaacaaaatatttacggcttattgtcgctttggtttgagccacaacatggagaaataagggaaacgtcggggcattatatcttctatgatacgggaggtgataaattcatcggcagttcc

SEQ ID NO: 1096 - DNA (genomic), 3215 bp, PORYPHYROMONAS GINGIVALIS; double-stranded, circular
  misc_feature 1...3215
  hypothetical: NO
  anti-sense: UNKNOWN
cgaagaggaaaaatcgactgtcagcttcgtaagacatgactcaaagcatttaggagatactccaaatcagcttcttcgtgatagggagagagcgacaaacgtactgttccggtagcgaaggtaccaatcgatcgatgcgccaacggcgcacaatgaatccccgtgcgagtgacaatgtcgaatgcttcgtacagagcatcgcctatacgtgcaggtgtcagccggtcatgcgtcagcgagcatagatagccctgctcgatcgggtcagcagcaccatacacccgaagtcccgggaaccgctgcatctgctgcatacactgtttcacgcgtcccgactgatacgaaaggncggaagttggcgaacggaagccagcaaagcggtaagcccaagcacattgaccgtgccggccataaaccgctccggcatctccacccccactgtccagtcagccgaatgcaaaccattgccacctgtggtcagagggtgaacgcttcgtgggtcacggatatagaatccgcccgtacccgaaggccccaaaagtcctttgtgaccggtaaaagccacataagccaaccccaatttcatcagctttgagtcgtgaagttccgagatactgcgtagcatcggccaagatagggatgccgcgctcctgtgtgagcaaacgggctatctcctctatgggctggaccagaccattgacattgctctccagattgaccacagcgagagccgtatctgtgggaatggcactgaccagccggtcggtatcgactcgtccgtcaggcatcgaaggcatgagggcaatctttagaccgatggtatcagccagacattggagcggacgcatcacagcattgtgctccatcggactgaccagcacgctacagcctgcctgcaaagagcctcgaagaatggtattgatacctgtagtggcattatccgcaaaacagatatgagccgactcggatacaccgatcaggtcggccaaagcatcgcgcaactcttctacttccgaagtaacgcgcagcgtctctctatcgcggctgcggccgtaactccctaccggcacatcgtagaaatacgccaaagcctgacgcatggcatcgggtttaggataagaggaggtggcgttatcgaaatatgtattcatccgcaatgcggcaactcatcaagagcaaatgggaggtattcctcgctacgggagacattatactgccggttctgacaaatcgttcgaatccaaacagctgtcaaagataactacatttgctgatgttctcgtaccactattccacagtcacgccgatttcctgcatcgtgattacggctttatctcccgatgcggcagttgcatccaagcggatgaagcgcgtccggacgatttgattcatatctacagtttgaggcagaggattattgatcacattggcaaactctcccatagtcgggatctctcgccactgtctgccatcttcactcacagccagccgatagcggacggcagtcgtaggcttggcttcggccttatatggcgcataggtaaaagcgcgcaacatgacctctctacccagatcgatagtcaatggatcgtccgaaagcagcctccagtctgcacgtggaatatcgttccacgactcatcggcaacgacctgctccggtggctcggcataatacacagctacgcgacacagattgaccggcagacgacactgttctatacgtacccgtatccgatccgtctcgactgcaggaatgcgaagaagtcgcttatagccgatagtcgtaccgcggccgatctcctgccatgctccatccacccacgcctccacagtgaaagcctcggtgcgctgccccttagtaatatcctcttggagcatcagtatattgatgtgcgtcttagattcgagtgcatattcttcgacggcatgtccttgaacaacggcatagcgcgccgaatccactaccctgtcatgagcaaaggcccgaccgagatagtcagcccactccttcaggcgcaaggcatcggcttcgtggatcaggcctcgcctatcggcggtacattgagcaggagtactgaattataacctacggactggaagtaaatatccaccaacttgtccaaatgacttgactttcttgtcctcagcagcatggtaaaaccaacccggacgaatagaaacgtccacttcggacggataccaaaagatttcgccagcttctttcagcacctctcggctgcccaaatccggagagttctccctaattcccagacgattgcgttccgtcttcgaacgggaataaatacccggcgtaagcactgtggcactccactcggtggttcgtcccagtccacgctcattgcctacccagcgcacatcgtctcccatgatagccataacggcttgggttgcagtcgcggatggtgtcgtagaatgtctcccaatcatattcctgtcgcttgccgttgggccttcgccattggctccatcgaaccatacttcgtgtacttctccatagtgagtgagcagttcggtaagctgactgacaaaaaaccgattgtaacggtgcgaatcgccatagcactccgcattgcgatcccaaggagacagataaatgccgaacttcataccatactcttcgcacgctgctcggacttctttcaccacatcgcctttgccctctcgccacggagatgaagccaccgaatggcgcgtggtggctgtaggccagagacaaaaaccatcgtggtgcttggccgtaaggattaccatgcgaaagcccgcttcgtgcagtattcgtacccattgccgagcatccagctccaccgggttgaagagtgccggatcttctttcccatcaccccactcactgtcggtaaaagtattgatgccgaagtgcagaaatgccgtcagctccatctgctgccaagccagctgttgtagggtagggactacctttgccgccatctccaccttctgttccaaagtggcatcggcaggaaaaaccacagaccccggatagtagacttcttgcccctgcccagaaacagcagtaagcaaaaagacaaaaagcaggaggaaacgatttgttatcagggttttcatttatcgaatgtttttgattgcctaaaagggaagtgacgtgtactgaaaaagtttgacactcaaagagtgtctgattcgtgattaaaattacagtgtttcttctaaagtcc

SEQ ID NO: 1097 - DNA (genomic), 6574 bp, PORYPHYROMONAS GINGIVALIS; double-stranded, circular
  misc_feature 1...6574
  hypothetical: NO
  anti-sense: UNKNOWN
tgctggcgagccactcgtcctgtcacagatctgtccaccttattggtaagccaatccttacaagctactgactccatacgcaatacctgctccagatattcatccagacgggcagggtcgtattgcggtgcctgatagcgatgttctatggttctgtcctccatgatggtacggggaggcttgccaaacatgtcgtccagcttcatgtcgataggacactcgccattgtccttgcggaagacgaagcgcatatcgtcagtggtctctccgaccacatacatgggagcgcgttcgcgttcggctattttgcgtacatattccaaatctttctcctgcatcagcatccccatacgttcctgactctcgttgccgattatctctttggcagagagggtagggtctccgacgggaagccgatccatgtcgattcgtccgccggtcgcttccaccaattcggacaggcagttgagatgtcctccggctccgtgatcgtggatggagacgatcgggttattgtcattttccgctatagctctgatcacattctgtacacgcttctgcatctcgggattagagcgctggatggcattcagttctatactgccggacaattgtcccgtattcacagagctgacagctccgccacccatacctatgcggtaattgtctccacccaggattactactttttctcccggagacggctctcctttaagagcgtccgactgtttggcatagccgacacctccggcaagcatgatgactttgtcatagccatagcaggtagtatcgggagtttcttggtgttcaaaggtcagaacggatcctgtaatgagtggctggccgaatttattgccgaaatcgctggcaccgttagaggccttggtcaagatctgacggggcgattgatagagccaacggcgttcggatagtttcttttcgaatggtcgtgttccatcagtacgggcgtaagaagtcatatagacagcggtacctgccaacggaatgctgctctttccaccggccattcggtcacgaatctctccccctgtccctgtggctgcgccattgaaaggctccaccgtagtagggaaattatgtgtctcggctttgagactcagtacggtatccatcgttttggtttcgaagtagtccggtttgtctgcactgcggggggcaaattgctctaccttcgggccttggatgaaagccacattgtccttgtatgcggacacaagcaaattgggattgacagcagaggtacgtttgatcaggttgaagagagagctttccttctcctctccatcaataataaacgtgccgccgaatatcttgtgccggcagtgttcggaattaacctgtgagaatccgaacaactcgctgtccgtgaggggcctgccaatgcgttcggacacgcctttcagataactgatttcatcttcgctcagagccaatccctcagcttcattataagcgcgaatgtccttgacggaaatgatcggctcaggcttacgatctatatcgaaaatcttttggtccagctgctcatagagagcttgaagcatgggatcgaactctgcatcggcacctttcaccggaaagaactcttcgatacggcgtatgcctgcaacgttcatattctgcgttatctcgacggcgttggtactccaaggtgttaccatctcccgacgagggcctacgtgatagccgtttacaacatcggactgacagggttcggctcccccaaacagccataccagccgatgtatttcttcttcgctgaactgaacttcactctccacggcataagacagagcnggacgaatggtgaaagaataaaatcattatggatatgctttagaatgcttttgactgaatttttttcttacggacaaagataaacgaaaaaaggagtgtcgtgcccaatagcgtgctaaacgttttttaggttgtttatgaaaaagggagaggctctttccagtgcctctccttcggttttatcggagttgctttggataaataagcttacctggagctttacaaataaatataggtcttttcgcccaagtcatccgtctgttaccctccatgcttcgattaaggaactttcagcagagtttcaggcagacagcatagcaaaggtttcacaagctcttcagccaatttgcaggctgcatgtcctttatggagatcaacaatggtctgcgttcggccacaggcaatctcccgcgatagatccctcgctgcaagcgcgtaatgacaatcttgcgagagaaattccttgccgcaagcctgcggcaaagaattttgtatacaaaatcacttgctgcaagcctgcagcatagaatctcgcgaacaaaattcatagaatcctatctgcaatgtacaatcttgcgaacaaaattgctttttgcaggcgtgaaatggcgattttgcataaaaaatcactcattgcaagcggaaaatagcgattttgttggcaaacttactcgccgcaagcctgcggctaagaattttgtatgcaaaattccttgctgcaagcctgcagcatagaatctcgcgaacaaaattcatagaatcctatcagcaatgtacaatcttgcgaacaaaattgccttttgcaggcgtgaaatgacgattttgcataaaaaatcactcgttgcaagcggaaaatagcgattttgttggcaaacttactcgccgcaagcctgcggctaagaattttgtatgcaaaattccttactgcaagcctgcagcatagaatctcgcgaacaaaatttcttattgcaagcctgcagtaagaaatctttatgcataaaatcaccattgccgaactgtgacaaaggactctgccacggaagtttatatatttctattatatattatatacaaatcgaaaaacaatctatataagactattattatcccgttaaaataggattgtagtaaaaactaatcaaaaactcaatcaaaaagagggtaatcgagttcttttacatcattgaaattcatcttttcaaataaatatctaagaggagccttatcggtcaatgagatacctgtacattgacctaaacaacacctattgagagatgctatttgcttgaagcctatactgttttgtagctccacaaagcgattataagagacaagatgtggaaacttgggccgacctgagcaggtgatatattgaagataaaaagctttccaattttggcgttttgagagatgaaacaggatcaggatggtcatgatcttgctgtccgagatcttaacctttctattccaacgtcgaacagacattgtaattagtcacaaaccggacctttccgagtgccgactctctttcagtacacgtcatcggcacaaaagaaacagttgttggactcaacttacaaaagaaactttttcaaaaacactcttctacggaaatatcgtatatatttgtattcaaatacataaacccgatgaaacgcctcctgctctgcctcattgttattgctcagaccatcctatccttaactgcccagaccacagaagaattgagccgaatgcagactctcatcgaccatatggcctatacggaggctttggcttgggcggacagttgcagcctgcaagacgagcaagctctacacctccgagccaaagctctcagcgaactgggacgacatcccgaagcctttgccgtctaccaaaggatcgtacggatggatcctcacgatgcggtagcttatcgtttgggggcagcgttgcaagtggatatgcaggattatgccacagcggccgaaatgctgcatcaaggctatgagcgcacgtccgatattccgacagggtacgacttggccaaactgctcgttcacatcggacaggattccacggcattggtcatcacagacaggatcttacggcaggattcgctccctcccgtcattcgccttagggcaaaagcactcaacaaacgacaacaaccttctcaagcgatagcactgttggaagagcagatgcttcgggattctaccgatttccttaccctgattgatctggctaccctgtacggacaggtagaagaaacgcgccggcaggaacaggtgacagcacgctatctgcaaactgactcgctgaacgtggccgtacttctggcccatgccgaatccatgatgatgctacaggaagcggatagtgccctgcatgactatgagcggattatcggtcgaggccatttccccacctcattcaaggatctcttctattgcggtttggcgtactacaaaaccggtaggtgggccgtagccgaagaatgcttcagacgagccgacgaatccgccttccaacaaaactacctgaccaaatactacttgggcatgtgtgcctatcgccaaaagctgtgggaagaagcggaaaagcggttgcagaagttgctcgatctgatcgaaccgaaacggacagactcaccgatgtgcatacgatgctcggtcgatgcgccaatgaacaagggcgaacggaaacagccatatcccatctgcgctatgccatagaatacgatagcggcaacagcgaggcctgcctgctccttgctcaatgctttgaaaagacaggcaaccgcaccggtgcgatccacatgtaccggcgtgtcctcgacaaggaaagagcaagtacggcgaaaaacgacatagagggcttccgccgattggctgaagcacggagcaggctatccctcctgaaagccgacgattcggaggacgaggaaacgccgtagacattacgtatatacattcattctccggaacgatccgaaatggagacaatcattggcgaacatattgttttgtgctcattgccaaatttttacatccccatacggctactttgattcatagaagtttcgactgagatcttcgtgccgtttcttctccaccgacaacttccgacaacgacccgttcacactcctcgaaaaggaagcgcagaatccccatttttggggagaattaatgtgtttttgggctactttgttagtcgggttagcaagatttgtgtatttttgccgcatcattagagttgtttgccttagacaatcaaacaaaaagacaaccacatttgcctaactatttaaaatgggcgagattatcagtcatagcggagttgtcagccgagtggaagccgacaagataacggtatgtgtgcagcagaaaagtgcatgcgccggttgtcatgccgccggctattgctcctctacagactgcaaagatcgatatatcaccgtaatgggacccgcacctgacatccgcgaaggtgatcgggttttgctggaaggtcatagtgccatgggacgtcttgctgtcatcctctctttcattgtccctttgattttgttgctgcttatgcttgtcctcaccatcagtattctgaggttggacgagggcatgagtacgcttatttctttgggagctttgggagtatactacctgattctccggttattcaacggcaaactgagccgacgtttggtatttactattcgaaaaaataatcagtaacaaacaaatatgatacttactactgtgattgttttggccgcaatcggtgccatcggtgcactggttttgtttttggccgcaaagaagttcgaggtcaaggaagacccacgcatcggactggttgcagaggtactccctcaagccaactgtgggggatgtggcttccccggatgctccggttttgccaatgcctgcgtcaaagccgaaagcctcgaaggactgctctgtcccgtagggggagcagcggtgatggggcagatagccgacatcctcggcatggccgcggccgctcaggatccgaagattgccgtggttcgttgcaatggcaattgcgatgcccgtccgcgtacgaacctgtacgacggagcctccagctgtgcagtagccgcttcgctatatagcggagacacgggctgtagcttcggctgtctgggattgggcgattgtgtggatgcctgcggattcgatgctatccgcatcaacccgacaaccttgctgccggaagtggtggaggatgcttgtacggcatgtggtgcttgtgtcaaggcctgtcccaaatcgatcatcgaactccggaagaaagggcctaagagccgccgtatctttgttagctgcgtgaacaaggacaaaggcggtgtcgccaagaaagcttgtagcaatgcttgtatcggctgctcgctctgcttgaagcaatgccaattcgaggctatcaccatcgagaacaacctctcgtacatagaccacaccaagtgtcgcatgtgccgcaagtgtgtggaagtatgtcccacgaatgccatccacgagctgaacttcccaccgaagaagaaagtggagccggctgtcgccacagaagctgccgcaccggcacaagagactgtctaaggaataaataacaacaaagaccacatagaattattatgttgaggactttccgaatcggtggtattcacccccccgaaaacaagttgtcggcaggcaagcccgtagaggtgttgcctatccctcacaggtagtcatccctcttggtcagcacatc

SEQ ID NO: 1098 - DNA (genomic), 495 bp, PORYPHYROMONAS GINGIVALIS; double-stranded, circular
  misc_feature 1...495
  hypothetical: NO
  anti-sense: UNKNOWN
cggctggatatgctccgaacgtccgttgcctcgggagacggtactgaccttgcggttccaattggagtattggggcgatatatatcggttgatgaagcaggttttccctcaagcctcggacgaatggctgttcggttttacctcggatcaattgctttggatgaagcaaaacaggaaaatcctattggacaatgctcttaaacgcggcgagatggagtcttctcagccgactgtcacggatcggtacttcaaggagttgcctcccgatcagctgttacctcccgaagctcctcgcctgatcggtcattggcttggaaccaacctgtaagctcaggtagtattagggcaaccgcatcaatatgatttgtttagagcgaggagcttcgttttcgtcctctgactgaactcctaatggttgtcctggtgcacattggtatttatggcacaccggctatctttgcaacccgatcttattcaatcctgacctccaatatg

SEQ ID NO: 1099 - DNA (genomic), 534 bp, PORYPHYROMONAS GINGIVALIS; double-stranded, circular
  misc_feature 1...534
  hypothetical: NO
  anti-sense: UNKNOWN
ggagcctaaaccctcgcagagggagggagtcgngatgtgtagtttcccggacttccgagtacaggttcaggctctgtattgagcaggtcttcatatcggtaggcctcgtgtcaggtattggttgtccgccgcttgcggagcatcaggtcgttggctcggagcaatcggcagaacctgtcccgaccgatcgagaactactctccgaagtactgcttacagaaaatgtaaagcccgaatgctgtccgatctttactttgtgggtaataattggattatatccggtcggaatttctgtacttttgattagaaataggcatcccatttttctttcaaaaaagaacacaaatacgttgtattatgatgaagccatctctttttttgacacttgttgctgtgttttttatggtgacaataaaaggattagcaaaaccacaaatagacaaagaggtcgatcccataacgaagctgactttacgaaatccccagaatggaggcagcggggttttatggacaaatatcccatgctctgctgat

SEQ ID NO: 1100 - DNA (genomic), 995 bp, PORYPHYROMONAS GINGIVALIS; double-stranded, circular
  misc_feature 1...995
  hypothetical: NO
  anti-sense: UNKNOWN
cggaatatcagcgtattcgcttatctcacgacactggatgggatgctcgcttaggcatttattgggacgatggttggtactatgtctattgtagtggctttctactcaatcgctttagagtagaagagatgcaggatcatacttaccgcatcacacgaatacagtactgcacgcagcacgaggagggcaaggcctataatgctctcatcaaggctctatctcttgacggtctagatatgtcggcttattctcagtataaggactagcttcataaaaacgattgcacctaacagcattctctaagatgctgttaggcgacttcttattactgctggagttgttgagtgagggcttcttgctcttgggagaggagttgttgctggagctggagttcggcttggcgttcgatggctagttcgtagttcgtgacacgagagcggagcttgcgaatggagtcggaggagtcttcggaggagaaaaggctgtcaaggctggcgatgtttggctgtgtatagccgagctccattcgtagaatacgatagcggagagcatgactatcaagggcttgattgacgccatagagatgtgtcgcccaaccaatgacgcaggcaaggacagcgatcatcacaccccatatgagccattctgcccagcgtttgacatcgaaaaggtagtatttggaaagctttatttcgggtgtggtttgtttagtttggagttctgtcaagagtttgtcggtcgcttcgtcttgacttatccgtacctcggtaatgcctgacttcatttcgtagatgcgctctccaagtttagcaattacttgacaaagttcctctctgaatcgacgatgaaactcctgttgctcctctaaaatcttggcgattcctgcgagattttttcctattctcgacttctccttgcgactctgttggttgtggtaaattggagatactcgctttgagttctctgttctgttgcttgatttcttcgagtacttc

SEQ ID NO: 1101 - DNA (genomic), 1540 bp, PORYPHYROMONAS GINGIVALIS; double-stranded, circular
  misc_feature 1...1540
  hypothetical: NO
  anti-sense: UNKNOWN
cgccggcgagggagaaatagacgaccatgccatcatcagcggcggagtgttgatacaccagttcgtacgcatctctcagcatgtgatgatccaaggtggctcccgcctctcgaaggacatccctccgtatgtactggtgggacgggatcctctcgtttattgcggaatcaacatcgtaggtctgcgccgccgaaatttcaccaacgagcagattttcctgatcaatgatatttaccgcacactttaccaaagaggactgaataattccgatgcgatcgatattatccagcaggagtacgccgattgtcatgagaaggaacttatattagactttatcaagtcttccaaacgcggcattgtccgcggaaccatggagtgaagccatgatcgggatattcactggagcacgcatcaaggagcttgaccgctacacgatagagcacgagcctgtctcttcgatcgatttagtcgaacgagcagccgccacatgggtgtatgaattcgaacgtctctacacccagcagcgccggatcgtagtcttcgccggccctggcaataatggagcggatgccctgtgtgcagcccgtattctgggcgaaaacggctattcggtggatgcctttctcttcaatgtcagcggatcgctcagccccgaatgcaacgaatgcagggtacgcctgttggagacttcggggatcaggctgaccgaggtggtggacaacttcattccgccggaactttccagccagaccatagtggtggacggtcttttcggcgtgggactgaatcgtcctctacagggcggatttgccaaggtcgtggagttcctcaaccaatccggagcagagatcgtatcaatagacatcccttcggggctgttcgaagaggataacttcggcaataatccgaatgccatcatcagagccacacacacccttacgttcgaatatcccaaactatccttcctcttctccgaaaacgccgactatgtaggcaagtggaaagtcctgaatatcggtctgagcgtcgaaggaaagcaaacgatcaagacagagtatttcctcaataccgatttcgatatatccggcatcatccggcaacgccctcgttttgcgcacaaaggaacgttcggccatgctctgctcatagcgggaagtcggggcaagatgggagcggcttgtctggctgcaaaggcttgtctccgaagcggtatcggtctattaactacccatatacccgcctgtggcgaggctgtcatgcagaccgccgtgccggaggccatggtacatgccgatgaaaagacggatatagtctgcgactattcctctccgctggtttttcaggctgtaggtatcggccccggcataggacgggcagaaggcacagtccttttggtcgaaaagatactttccactcctaacggccccttggtgcttgatgccgatgccttgaacatcattgcagaaaaccgcagttggctcgatcgtctgcctatcaacagcatcctcacacctcactcgcgagaactggaacggctgac

SEQ ID NO: 1102 - DNA (genomic), 1131 bp, PORYPHYROMONAS GINGIVALIS; double-stranded, circular
  misc_feature 1...1131
  hypothetical: NO
  anti-sense: UNKNOWN
aacaaactcaacaaaaaagaatatccaattagcaagatccaatataattcagaagtcgggaagtttcttcgggcaactttaatagtcgtatcaacgatccaatgcaccaagaacatataacggaaaggacaagaaccgcttaaattcaaggagccaaatttatttgtagattcgtctttcattcttatattattatatttaaaccattgtataaatatccatttactcttcatttgcaaatgggctttcacagacaaactttagtctattttttgatcagattcaatgatttaagcaaaagaaattggctatcaacagctcgcacttttcaatagcaagtgtaataacggaacaaatttaaggcaaaaactgagaaatgagttctgagcttcgtcttttcgaacaggctgttcgataccaatagcgataacaataaaagcgcagcaaccgggcctatacggctgggatttttgctacttttgtagagcgatagggagttctcgacaatgtaaatggtggttctggaagggcttgtctgtcgaatagaacagctttacgaacgtttactaactacttaatagcaacagatatgatgcactctgacttctctctttctatacggtcattaggtggatttcatgcggcctatacaggtatgtaccatcgcgtggcatgtggacaaaggagatattattccatgaggagtaagcacgaataggcattcgatagcttctataacgtataaggcacccacccgattctttcataaatcagatgggtgcctctgttttatcagcttacaatatggcattttgggggctgcgattgatatacaaatcattttcgatttctatatatattgaaaacgatttatatataaatggaaaatggtttatatatagatcgttattcgatataacgagaaaggtatttcaatctgaaaaaggagtatttccatctcttttgtatcataaccagacttcttagagccggcttatttggaatgattctaaactcctcttcgctgttgaaaacttttttggcacctatttttcggtcacaataccgattttcttagttgtttttaggcctaagatccttctctctttcagcctgcagcggtgcaggctt

SEQ ID NO: 1103 - DNA (genomic), 4543 bp, PORYPHYROMONAS GINGIVALIS; double-stranded, circular
  misc_feature 1...4543
  hypothetical: NO
  anti-sense: UNKNOWN
ggcgcgagaagtaaaatttttacgcgccagaacgaaaaaaatctcgcgccacctcttccgaaaaacacgagccgcagatgtgtaaaaactcgcacagaaaaagttgatgtgggtacaaaaagaagaagagagaggaggagagccccgatatccgataaaactactcaccagataccttccgaaaacataaatatcggatctgcatcaatagtgtcctaaaagtcagtttttggcaatagaaaggagaggaacttccggtgtctctccttcgttgtgttatcaagagtctccttgggccaataatataagcctgcttgcccaagttgttcgcttgtagcctcgccccttgattaagaatctctcggcaggagttcccaagtagacaagcacagcaatcctatctactacaaaacaacatacgatttttttcagtacaggtcatttcgataattttgtgtctatatttgacaggtagtagcaccgaattttccatcgggaaaaaagagtgctgtgggcgtttaattagagatactaactcatgtatgggaactctctgtagatatgcaatctaagtttgcaataccaaggcggacagatctcatcaaaaacaaagcgtattatgaagaaatttattcaggacttcaaagcgtttgcccttaagggtaacgtagtggacatggctgtcggtgtgatcatcggtggcgcattcggaaagatcgtcacctcgttggtgaacgacatcatgatgcctcccatcagtttgctgacgggtggggtcaacttcacagatctgaaattggtattgagcaaggctgtcgtcgaaggcggagaggtcgtgaaaccggaagtgtcatggaactatggcaattttatccagactacggtggacttcctgattttagctttcgtgatcttcctgatgatcaaagctatcatggctgccaagaggaaagaagaggaggcacctgcagctcctgctcctacgccacctgaaatcgaactgcttacagagattcgcgatttgctcaagaagcaataagcacagtagtctcccctactcttggccgcaaatggcgaggatataccctccgaccggccgaccgggaatgggtgagaaataaagagaaaccactactcacaactatcgaatatggggcatgcacgctctgccgatagtttgggtagtggtttctttgtttttccgtttactctttgataataagcgttccgattgaagaaaagtgtccgtaataagtgcattatatacatttcttttctatttttgtggtcgctcagcggcttacatcccgatgacctttggacgcctaccactcatgcaccggcagacgttcggagcagccgatgttaacctccggcagtttaatttagaaaatcacattcaaaaagaatctaagcaatgattattggcattccaaaagagattatgcacggcgaaaaccgtgtgtcggctacccctgaaacagtggccaaatttgtagcagacgggttcaaagttctgtttgaaaaaggagcaggagaaggtgctcagtatcatgacgaagaatatgcccaggcaggtgctacgctggtagacggagctaaggccgtttatgacggtgccgaagtgatcctcaaggtaaaagagcctttgttcaacgaacagctcaatacgcacgaagtagagctgatgcgcaaaggtcagtatctgatcacattcattcatccggcttcaccggtgaacccacgaaatggtacgcaatctggccaaacagggtgttatctcgctgactctcgatggtatcccccgtatctcacgtgcacaaaacctcgacgcactgacttcgatgagtacttgtgccggctacaaaggtatcctgatggctgccgaagacttcgccagcttcatcccgatgatgggtacggctgtcggtatgattccgcccgccaaagtaatggtgatcggtgtgggtgtggctggcttgcaggctttggctacggctaagcgtctgggagccatcacttatgctgccgatattcgccctgcagctgccgaacaggctcagagcttgggagccaaatcgtggataccgaccgttcctgccgaactggctatcgccgaaggcggatatgccaacaaatggcccgatgatgtactggccaaagaacgcgaagccctcaaggccaccattcaggatatggatatcgtattctgtagcgcattgatcccgggcaaggtggctccgatcatcatcacggaagaaatggtgaagggtatgaagcgcggctccgtaatcgtggacatctctatcgaccagggcggtaactgcgaaatcacgccgaagggaaccaaggaagtgaagcacggagtgatgatccaaggtatcaagaacatccccggtatgcttccgaaaagctctacttggatgttcgcacagaacatgtacaatctgatgaagtacctcacaaagaacggtcggatcgaattggatatgaacgacgaagtttgcagcaagatcctcgttactcgcgacggcgaaatcaaacacgccggtactcgtgaagcaatgggtctgtaatcgaactgttcctacatcttaatatcaagagccaaggaacgacccctctcaagtggccgtcctttggctcttactcatttgagctaatacaccaatcactcatataataatgaatccgatcattcttatcatcgtgctgatagcttccacgcttatcggctacaagctgatcagcaatgtgccgagcttgctgcatactccgctgatgtcgggtatgaacgctctctccggagtaaccgtaatcggagctattgcagctgccggattatctttcaagttcgggcatgacggcaaactcatcctcggccaaatcttcggaggactggccatcatcctcgctaccatcaatgtggtgggaggtttcggtgtcacgcaccgcatgctccgtatgtttagcaagaaaaagaaaggaggcgaccaatgagtcctaccatctattatatactctgcgtcctcctctctctgatggtattggggggaatatcgatgatgagccgtgtgaagactgccgtcatgggcaataccctcagtgcagtggccatgttgggcggtatcatccttacccttgtttacaatgagatcttgcctgcctggtcggtttatatcttcctgattatcggtgccggtatcggttggacgatggcacagcgtgtcaagatgatacagatgcctcagatggtggccttgcttaacggtgtcggaggggctgcttccgctctcgtggggattttgtctctcgcagctataggaatcaatccgaataataacacggctgccgactatccgatcttttcgcaagctaccggtatgctggcactgactgtcggtatgattaccctcataggtagccttatcgccgccggtaagctacacaaactactgcctcagagaccggtgatatggcctaaccactcgatgtttacctctttgctactgatcctgaccgtgggattcgtggtgctcggttctgtttctatcgaagggtttcccctcttctgggctatcatcggaggactgtttttctcctctctcttcggtttgttcttctctatccgtgtcggtggagcggatatgcctattaccatttcgctactgaactcccttagcggtgtggccggagccattgccggtatggctgtgggcgatattctactcgtagccgtaggaggtattgtcggtgccagtggtctgttgctgacgcagattatgtgccgcgccatgaaccgcaagctcatgtccattctgatggcttcgggagcaaaagcaacacctgccgctacaacgccgactactgcttcaaaacaagaaaaaggagaggttgccgctcctgctcctgccaaagcagagaagacagccggtagcgtactgcgcgatgccaagcgagtcatcatcgtacccggttacggtatggcattggctcaggcacagcaccaagtaagacagctggccgataaacttacggctaacggtacggaagttcgctatgccatccatccggtggcgggtcgtatgcccggacacatgaacgtgcttctgtgcgaagccgatgtgccctatgaccaactcttcgagatggatgccatcaacggagacttcgctcagacggatgccgtggtagtaatcggtgccaacgacgtaatgaaccctgctgctcgcaatgctgagggtacgcctatatacggtatgcccgtgctgaacgtggacgatgctcccgaagtaatcatttgcaacttcgacctgaaacccggttacgcaggtgtggacaatccgctctatacacgagcaacgggtgtattcctcaaactcggagatgccaaggaatctctggcagagatcatgaaggaaatggatgccacaggcgatacggcagctactgctgctcctgccaaagcagagaagacagccggtagcgtactgcgcgatgccaagcgagtcatcatcgtacccggttacggtatggcattggc

SEQ ID NO: 1104 - DNA (genomic), 441 bp, PORYPHYROMONAS GINGIVALIS; double-stranded, circular
  misc_feature 1...441
  hypothetical: NO
  anti-sense: UNKNOWN
gcgtctggtcatgatccattcacgtccgtccaattcaacgatgttatcctcggttaaattggacacatcaatatacgccaggccactgaaacaggagaatatgaaaatatcgcgaaccaaatccaatctgggtatggatatttcttttccaatgattcgctgaatttcttcatcggttagaaaccctctgctggaatcttgcgtatgaaaccgcttgttcacaaaggggtcatgagacagaaatccatgtctgcgcccataaagagtaatggttttgaaaagcttcaagattttggttgccgtattcggacaacaatgagctacagtcagcagatatatctcaaagttatgaatgaccaacggggtaagctctgagaatttgagatccgttctgttgtacttcgctttgaggaatcgggtaaaatgccgttgctggtttcg

SEQ ID NO: 1105 - DNA (genomic), 2757 bp, PORYPHYROMONAS GINGIVALIS; double-stranded, circular
  misc_feature 1...2757
  hypothetical: NO
  anti-sense: UNKNOWN
cataatccaagtcgtctctgaaaaacaaaggccaatatagccttttttgccgaaagtggcaaagaactttgttaaattcttttctcttccactaacaaaactattcgttccgtcagggcgtcttccggattcttgtcaggttcgtaccgagtcttcaggctcgcaccatagaagcgggcgaagagattccaccatcccgctttccatccgccgagaaaagctttgagtagctgatagctcgactgtgcacactgtcggtcgatcagcttgatcaggagcttcccctgccggagggtcagtcgtttcatctccggcatgtattgctgcttcatctccttttccatgcgcttgagatgcttttgtctgcttttctcatcgggcatcgtttccatatattcgtacgtttcgatcagagtagctgcgatcattttggcatagggcaaggtgcgttttacatcccgaatcagcctccaaagctcttgtctctcctgcggtgtcagctggcgcgacttgtacttcttatgtttcacccacacctgcggcaaagcgatgtcgtacaccgtatcaccctgctccatggtgactacggtaccgtagcgcaacatggagtccggtatacccaatcgcggctcttgcgcgtacagttggctcaagatcaagagctgcacacccgacaaaaacagcaaaaacaatgctcttttatacatgttccaaacttacaaaaaaaccgattgagactgctaatatgattgtggcacaaatcataatcgattgattcgcaaagtcttctctctaaagcgacagtcctttacgtccatatcgatgtattatagtccgcttccggataattcctctttatcgcaaaagaaattctcggaacagtaggtggctgccccgatattcttttggttccaaaattttcctgttatgcgttcctaaaaacgtggctcgagaaaattttcgttttggttcgggaagaaaataattctcgcgccaaagcgaaaaaaaagtcgcgcgtgttttccggaaaacgtggcccggaattttcgatgattccggttcgtaaaagaggaagtgtcaaaattcagtttagagtaaaggatactatcatttgtataggaaaaccgctaccaaatggacaaaatcatcctacttgatagcggtttttcctttatgattaaggtggcatttgtgtctttttgatagttggaaaatccttttttcggattttgacacagcccccttgtatatccgaggaacgaagaaacccgtactctttagttggtcttcatcaggcgttccagacggagcagttgatagtcgtagaacgagcggtcggcagcgttgcccgtggccttgcgattgcgatagatggtctgcacgcgcttgagttgttgcagtaggaggggtgcaatcacttcattcggggcctgcttggagaaggccgtaagacggaagaaggaatcggctccgtcctctgccgcgtggtgaccgccacaaccgagagcacatgggaggttgtcctcgctgagcttgtgcgacagggcatccagctcttcggacagacggcgtgccgtattcttgctttccgtggagagaccactatgggccgacatgaggtcgatggccaggttctgaatagaacgatcggcatcggtcagattgcccttcacgttgaagatggcatcgatcagctcgttggcgtaatccgtgagcttgtacacacccggttgtccggactgctctgcttcgtatatgcgtcctatgctaccggggttgaagagagccgccaccatggccttgcccaagaggtcggtcatcccagagttctgctctaccttgttgaggaaagccggttcggccagccactggcggtatgtgcgagcctgattgaggagccaattcatggccttgcgttgcttgtcttttgtgatgaagcgacgggaaagcgtattctcttcgccctggcggatttcgaagtgttccactcctccgatatagggcatgatgtggctcacatggcggtagtattgggacatgagctgtccgtgcatgtcgcgcagatcatcgtagcgagcttccttttcgaggagccatttgtccatgttcttggcgataatcttcaggttgctgatggacatgtcgccggcacggaagtgatcgttactgagatcctcggtctgatccgtggggtcgatggtataggggaactgctgtgctccgaaggtaaacatgggatcgtctttcttctcggcgatccaagcgttcagtgtcggcttttcctcttcagccgttttggctccgggcacgagacgataagcccagttgatggcatgaatgtcatacacaccgatgatggaggcgtcaggcgtacaccacgctccaagtcgccgggctgcgccacaaaagttgttgcgggcatagtccatgatactcggtgtggtaccgtatttttgggtgaactgcggatcgcgcaggttctcgatggtgaacgagtagctggcacccatgttgtgcatcaggccgatggtgtgaccgatctcgtgagctgccacatagcggagcgattcgcgcatcacttcatcgtcgaatacagccttgcgaacacgcggatccacggctcccgtctgtacgaaacgccagttgtgaacgagagacaatacattgtgataccagatcacatctgcacaaatgatctcgccgcttcgcgggtctacgaaactcggccccatggcgttggccgtggtcgttgtggca

SEQ ID NO: 1106 - DNA (genomic), 503 bp, PORYPHYROMONAS GINGIVALIS; double-stranded, circular
  misc_feature 1...503
  hypothetical: NO
  anti-sense: UNKNOWN
tattccttatagctggcagtgtcctacaaaagtgtctaagttcctaaagccaatactcatcgtacgcacatgattcaaatatctgttttcgttactctttaagtctctttaccattacgtaatctacttgattctctttgaccacattgaatccgctgcttagatacatttttgtcgcaaagttggctttttgtacagatagtgaggtttggatagcttgctgcgcgaagatgatcaagtaatctccaatcgtctaatgtgattttcgtaaaatgttctgtacgaaaatcgttcatcaatggaatcggtttgttgtgttctgtgtgagtgtaagtaaacccgcatttttcttgtaccctcttcgatttttcattgccgtcaaaataaccgcaccaaaccgctgtctgccgtaaattttcaaaagcataccgaagcactttcgtttacagcttcaggaattaagccctgtccccaaaatggttcgccaatccagaatcctattt

SEQ ID NO: 1107 - DNA (genomic), 705 bp, PORYPHYROMONAS GINGIVALIS; double-stranded, circular
  misc_feature 1...705
  hypothetical: NO
  anti-sense: UNKNOWN
cgaagtatccgagcaaagaagaaaatagaaaaacgataaaagtagaataagcatacgacaatggcaatgcagtatctgcaaagatctgggggataaaaaatatcatgacaatgcccccaagcataacaatagaggcaacaataaaataaacccacccctgaacggaaacaatctctcgtattgtctctcgatcattctctgcaatcggcttatataatgtaaatgatatagccgtagctatccccatctcagacaagttgagaaggcctaagagattagtaattgtagtattgagtcctaggagttcggcacctaaggcatcaataaaaactctacgtgagaagaaagttaaaataataagaagcccataaaacaaaagtgagattatactattttttgcactattggtcgttcgagaagtctccaccagatatttctttatagttgattaaataataagacattgcacaaaacataaaggcattgctccacctcatatagggaatcttagagctaaggccaggcttcatttgatagtaaaaatagcccttcttatcctgcatactgctaatagtccaagccataacccgatccaccaattcacgatgttcgtcatagcgatgaagtctagctagcgacacgaagagctgaccaggacatgatgtcgattggataagtcgatcgggataatactgggcataccat

SEQ ID NO: 1108 - DNA (genomic), 2367 bp, PORYPHYROMONAS GINGIVALIS; double-stranded, circular
  misc_feature 1...2367
  hypothetical: NO
  anti-sense: UNKNOWN
aacaatatgacgggggtggaatacagctttggcaaatgctgcaatcctatttacggggattccgtattcggattcgtgagcaatagcggtatcaagatacaccgcacggactgcccgaatgcgccggatatgttcagccgatacggttatcgcatcatcgaagctcgctggagcggtaagggatcgaccggatacgaggctacacttcatgtcataggacaggacaatctggccatcgtgacgaacataacttcggtcatcaataaagaaccaggcgtatcgctccgagcctattcgatcaattcgaaggacaatctcttcgaaggggtgttcacggtcgaagtacccgatacctcgacactatccatcctccttcgcaagatccgtgctacgcatggggtcaagtcggccgaacgacattgacagccccttgcaagtctttagtagtggagtacatggtctggatgatgtgtatcgtattcttgagcagaacggcttgcaagtctttagtagtggagtacatggtttcagacagaatagcgtatatttactatcaatatcgtgtaatgttataagcggataaggtatggcgagaatccttgccaccggcaggaaaaaagctgacggctatgcgtttatcacaggcctcgtcaaggaggtataaaataaaaggcaatggctcagagttagttaatagggcattacgacctgcttctctgaagacaaataaggaaacagactgatcaatgaaaaaactgatattatcggctcttgtgctgggtggagcaatgactttcacggcacaagcccaaaataaagcggcagagcccgccgaagagtttttcctcgaagggagagcgatgtttatccgccaaaattatgtgggtgccttagaccaattccgtctctatcgcttgcacgtagggcaagagcacgctttggaggtggattattatagtatcatcgcggactatctattgggagcggatcacgattacgtcctcagcgcggtaggcaatttcttggacaatttccccgaatcgatcgacaaatcccgtgtgcgactcctcacaggggagctgatgatccggcatgaacagtatttgcgtgccaataccattttctccgacatcgacgatcgcacgctcaacgatgaagacttggctgcatacctgctttattatgcatacgtgcgtatgcagttgagcgagagcaatgctttggccgagcagatgctgctgaaggcttccgagagcagaggtgagctgggcggacgtgcttgtctcctccttgctgctatccaaatagaggatggccgaatcgacgaagccgaacagactctttcgcgactgaagaatcgcccgcaatttgcggatgaagccgatgcttatatcgcggaaatccaactgttgcgaggcgactaccgcgaagcggccgaaatagccgacagactcttgtcgcgcaattcgcccatgagacagcgacctcaactcctgcgtgtggcaggcaatgcttactaccgtttgggcgattcgaacaaaaccatcgactatctttccgactacagcgaaaaggtgggggatcgtatcgcgcctgccgatgcttatgcacttggtgtcacttactataagcaaggtctgatgaaagaagcacttcggccacttgccgctgctaccactgacgccggttctctcggtgcagagtcggctctctatctcggacaggcacagctggccgaggggatgacgagcgaggcccttatggctttcgagaaggctgcgactcaggacgtcaatcggccggtacgggaggtcggaatgtacaatatggctatgctcatgcgtagtacgggacagtcgagcttcggtcagtccgtacgcattgcggagaacttcctcaatgagtttccccgatcttcccaccgcgaacagatggctgctattctcgtcgaatcatatttcaccggcaaggattacaattcttcccttagatcgatccaaaagattgcacagccgacggcttccattctggccgccaaacagtttgtgctgaaccgtatggcagaacaaaaggaagcagcgggctatgacagtgaagcactttcttttgtgtcgagcagtatatctatgggaaacaaaggggaatatttccctgaagcatatttcctccgaggcaatctgcggtatagagccggtgactttccgactgcagctgcggattacagagcctatatctcggccgccggtgatcgtgatgcggcgaatcttcctttaggatattatcgtctgggctattctctattcaatgccgaacgttacgatatggctttggaggccttccaagagtatgtatcccgatccggtattg

SEQ ID NO: 1109 - DNA (genomic), 783 bp, PORYPHYROMONAS GINGIVALIS; double-stranded, circular
  misc_feature 1...783
  hypothetical: NO
  anti-sense: UNKNOWN
gaccatagtatcctctcataggagaccatagtatcctctcataggagactatagtatcctctcatgtgagaccatagtatcctctcatatgagaccatagtatcctctcataggggaccatagtatcctcttgtatgagaccatagtatcctctcgtggaagttcattctttgtatctcagggaaagaccggtgagcaggtgtatcgctgtcaagtaaacagagagcagtgcccgaatacgttgccaatcgataagcatatcgacttggttcgaaaatacattcgggctttcctatatcgattcgctggcatgacgtccctgaatgaaacctcttctcgtcggatgattttccttgttgtgccatcgttttgtgtcattgagatcataccataaacacacaaaacaatcggccgacacactgtaaaatgaatggataaagtgcctgcttattgccgaaaggtctcagaaaagaaaaaaacacaaagagggcgcatcggtaagatgcgccctctgcttttcagtcgcccctatcttcaggggattatttatgcttgtctattgagcctttgcaacaggagccatcatgacaacaacccgattctgctgcttcaagaggtctgccgcaaacttttgcaattcagcaggagtaagaccgttcagtacggattcgtagtctgtgatgaagtcatttccttcgaagaaagacgccttcagggcttcgagccagaaacgattctcacgcagactttctttgtgctgcttattcagggggaccgagggga

SEQ ID NO: 1110 - DNA (genomic), 2738 bp, PORYPHYROMONAS GINGIVALIS; double-stranded, circular
  misc_feature 1...2738
  hypothetical: NO
  anti-sense: UNKNOWN
gccaaagccgccgatattcttttgcgtagaggctattttgtttacaaccttctgggcggatataaaggctatccgtacaagtaagtgatacctggagagctttcgggacaggtttctctacttgctctctacccatagctcttgttttcttctcctttaccccgaatggatcgtcctaagccttcatatattgttcgaatagcagccattctctgcttgtttgtcggcaggcctttgtttgcgcagagctatgtggactacgtcgatccgctgatcgggacgctaagttcttttgagctgagtgcgggcaatacctatccggtgatcggtttaccgtggggaatgaatagctggacaccgatgaccggtgtacccggtgacggctggcaatatacctactcggcacacaagattcgcggattcaaacagacccaccaacccagtccttggatcaacgactacggccaattctcccttcttccccttacggcaccgcagaagccatcatcgaacgactccatagctctgactaaatggtgcaagcaactcttttcggacgaacagacctcgtggttctcgcacaaagcggagacggcgacgccatactattatagtgtctatttggccgattacgacacacgcgtggagatggctccgaccgagcgtgcagctatctttcgcatacgttattccggcaataccgaaagtggctccggtcgatggcttcgtcttgatgcctttaccggtggttcggagattagcatcgtggatcctcacaccgtagtgggcatatctcgcaagaatagcggaggtgtgccggctaacttcgcctgttatttcatcctgcagtccgatactcctatggccgatgtcctgcttgagacagataccggcaagtcagacgaaggcacaagggcatgggcagcctgtcgcttcgattcgcaagaagttaccgtccgggtggcatcttcttttatcagtgtcgagcaggccgaaagaaatcttgcggaagtcaaagggcagagtttcgaccggatcagacttgccggtcgcgaagcttggaataaggtgctcggacgcatacatgtggaaggaggaacgaaggatgagcgcactacattctattccgcactctatcgctgtctgctttttccccgtcgcttctatgaggaggatgcttccggcaattttgtgcattacagcccctacaatggagaggtacttcccggttatctctataccgataccggattttgggacacttttcgagcccttttccccctgctcaatctgctgtatcccgatgaaaacattaaaattcaggaaggtctgctgaatgtatatcgcgagagtggctttttccccgaatgggccagtccgggccatcgggattgtatgataggcaacaactctgcttctgttctggcggatgcctacctcaagggtgttcgggtagaagatacccgtacactgatgaacggactcttgcatgctacgaaagccgtccatccgaaaatctcctccacgggtcgcaaaggttgggagtggtacaactccttaggttatgttccggctgatgcaggcatcgacgaaagtgctgcccgtacgctcgaatatgcttataacgattggtgcatcctccgactggggcgcacattgggttgggatagagctgcattggacacgttggctcatcgttcgatgaactatcgtcatctgttcgatccggaaaccaaactcatgcgcggtagaaatcaggatggtagtttccggacacctttttcccctttcaaatggggagatgtattcacggagggcaatgcctggcactacacttggtcggtctttcatgatgtgcaggggcttatcgacctgatgggaggagatcgcccgttcgtgtctatgctcgattcggtattcaatactcctcctatgttcgatgagagctattacggatttgtcatccacgaaatcagagagatgcaaatagcggatatgggcaattatgctcatggcaatcaacccatacagcatatgatatatctgtataatcatgccggtcatccatggaaagctcaggagagactacgcgaagtgatggggcggctctatcgtcctactccggatgggtattgcggcgatgaagacaacggacagacttcggcttggtacgttttctctgctttaggcttctatcctgttacacccgctacggatcagtatgtgctcggttcgccgattttttccaaggtaatactctcttttcccgacggacacaaaacggtgttgcatgctccggccaacagtgccgatacgccttacatccgctcgatcagcgtagaaggaaaagaatggagctgcaattacctgactcacgaacagcttcgctcttctgcatccattcaatggatgatggacacgaaacccaattataatcgtggtatgaaggaaagtgacagaccttattccttctccacggagcaacagcgtcgcgctaatcacagtaattaatgatacatttccccacttcggactatgaatacgaacaaagcatttacgccccgacgatctatactgatgagcttgcttggctttttcctccttgtgctaagctctgccggatgtaaagatgatgtccagaccgacatatttaaggggcctgtggactacgtgaatccttatatgggcaatatcagtcatctgctcattcccacttttcccactgtgcattggcccaa

SEQ ID NO: 1111 - DNA (genomic), 3671 bp, PORYPHYROMONAS GINGIVALIS; double-stranded, circular
  misc_feature 1...3671
  hypothetical: NO
  anti-sense: UNKNOWN
aggtgtcggaagaagttgtccttgaccacgcgctttattcttgacgaagtgcatcaccttggtctgcgcaccgccgaagcagtgtaccatgccatgaatgcgacgactcatttcgtccagtatggccttgaccacaggggcgtaggtacgtgtgggcgagagcacgagcttgcctgcgtccagccccaatccggctatggcatcggtcagcttcatgctgccgctatagaccaaatcgtccggcaccgagggatcgaaactctccggatacttctctgccagatagtgggcaaaaacgtcgtggcgagcagaggtcagtccgttgctccccataccgccgttgtactgttcctcgtaggaagcttgtccgaatgaggctaacccgacgataacgtcgccggccttgatacgggcattgtctatcacatccgatcgcttcatccggcaagtcaccgtactgtccacgatgatagtcctgacgagatcgcccacatcagccgtttcaccccccgtggcataggcattcacacccatgcgacgcagatcggccaggagttcttccgtgccgttgataatagccgataccacttcgcccggtatcagccgtttgttccggccgatggtcgaggacacaagtatattatccacggcaccgacgcacagcagatcgtctatattcatgatcagcgcatcctgtgcaattcctttccatacggagaggtctcccgtctcgcgccagtaaacgtatgcaagcgagcttttggtgccggccccgtcggcatgcatgatattgcaatagtcaggatcgcccccgagaatatccggaataatcttgcagaatgcctgagggaaaatacccttgtccacattcttgatggcggcatgcacatcctctttcgaggccgacactccgcgcaggttatagcgttcgttagacatatagctgcttcgtctttgttttcttgttttagcgcaagcgcagtatatcgccctcttggggtatatattcgccatccttgtcgttgagcttgtagaggttcttcatccggatgccatagcgttgggagatactgtgcatcgaatcgcccacacgcactacgtgctgtgtgtgtttggagatggagcatgcgtgctttttctccagatagatcacatcgcccttttcgatcgggaaatccacgggagcatcgttgtatttggccagtttggaggctctcatgtcgaactcttcggccaaagaatcgaaggtatcgccttgcttggctatgatgtagagcagtccgtagctgaagtaagcttcgtgcttgagtccgctctgcttctgcttggtcgtttgatgggattttttgttggacccggggtaagacttgtggaaccatgaggggtacttctcgcgatccaaagcatatagctcatacagctccaccatcttgatcagcagattggcatagccccgattggtggcatagccacagcgttgcaaccccgtagcccagccccgatagtcttctctgtcgagtttgaacaggggacgatagcgtggttggagcagaaatcgggaatgatcttcatacgattcgcgagcggccgaatagctgcggaagcattcgttcggcgcatcgtcggtacgataggtgcgcttgcccgtccacgatttgtggcatttgatcccgaagtgattgttgtgtacgctggccagtgtactggctccggctcctgtctccaccaaagcctgtgctatggtgatgcttgccggtatattgtagcggctcatctgtcggatagcttcgtcggcgtactgtttcacataagcctcgtatgtacggtttcgactctgagcctgtccgatcgctgtcccgaagaaaaagagaaccgaaacggaaagtatctgccaaatgtttgctctcatctgtttgaaatagttgcaacaaaacaacgttagctacaaaagtacaaataaattgcagtccgtcagggagattcggagcgatctcttttggaaattttcagtctcttccctctataatttgaatccctgagatatgaattcgtgcttgttttgataattgaatgtagcaatcatgaagctatacgtacattaggagttcaagtgcgattgccctgagtgatctacaccctctttatttgttctttaatacggacaggggattttccaattcctcaaccaatagatcgacccttgtacaggggttgtgattagcataatctttatccttgtgtttcaagcgaagtttttcggcatatcgctttgctaaaattccatctccatggtctttcaatatgttgtaaaaggagggatcattcttattgtatcggaaagaattatcattaagtcgcttttgtatcaagttttcaagtttggaaatgtaagcatcacggctgataggtacatccagatattggaaatggagaaggaaccacaattcaaaagcttcgtttgtccaagcgcatccgaaaccatagctctttgcaaggtcgatagcttgattaaaatcatcaaaatcgtctttatcaaagacaacccaaatccgatcaaagcctaattcacgctctttttcgagattatcccgaatctctttggctcgttcgactaatgcacaagtagaacaaccttgtcccctaatctctgcctcacgaacttccgagtagtggttgtcaatcaaagccttaaaatagttgggttccgtcttttgtccttcacaaacgatcaggaatcgaactattatgtcccgggtattctctttgcgttttcttgcggcttttgcttctcgcttttcacgttttagtcgttctatttctctttttggtggttgtcccatggctctacacttgaaaaaatgaacgggatagctccataacgtccgttaatatagtcgttttgaaaactccgatctttacgaacttttactccttctgcatctcgaaactctatcaatgaataaagatcggaggattctgtcctgtctttttccgtgaaccagatttgatcacggcgtaaataatcgcccttcagcagatttgtgtcgtgagtattaaagatcaactgtgctccattgggatttgtctccggagacataaacaacttcagaatacttctggtcaaaagggggtggagtttggcatctaattcgtctatcagcaaaacagaaccttctttcaatgtgtcgaataaagggcctgaaagctctatgactttcttggttccttccgattccatttcatccttggcgaaaattttttcctcgacctgattaccgtcttggtcatatacccaatgagaagttttgatttctaatacgcttcggccatcgaattctttcaatatgaattctttcaattcatccggtacttccttgagtacatcgttcgaaagaggttgctctgtgacgatcaagtctttgaatcctaactgcgtgcgacggaagaagtctttggcttcattacatccttccggattttctttgagcattttcagggtaaagccttcataaccctgtttttctacaaccgaaataagattgcagtgctgaaaccagtccaaaatagaagatgatttctttccatttagctgcgcacacaaggacacaaaaagtctattcccgggcgtagcatctgctttgctatcaccttccggaaatcgcttcttggat

SEQ ID NO: 1112 - DNA (genomic), 772 bp, PORYPHYROMONAS GINGIVALIS; double-stranded, circular
  misc_feature 1...772
  hypothetical: NO
  anti-sense: UNKNOWN
gtgtcggaacagctaagagacgggatagcgttcttcgcccgaaagtacccgcacatgaaatacctggcctatttccaagcctataccaatacctatggagagcaagccgagatcatccgtaaatacgaagaggctctgaactactacgatgtagtaggcattattataggtaccagaccggactgcatgccggattctcttttgtcctacttaaaggatttgtcggaaagagtattcgttctcgtggaatatggtgtagagagtacactggatgccactcttcggcgagtgaatcgtgggcacctctggtcggatagtatggcagctatcgagcgaacggctaagaccggattgccgataggtgtgcatctgatcctcgggctgccgggggaaagcagagaagatatactcaggcacgcggacaagatatcggcattgcccgtcactacactgaaattgcatcaactgcaaattatccgcggtacggctatggccaaagaatatgcagagagtccctcggactttcatttttactccgaggaggaatatatcgatctgtgtcttgatttcatcgaacgcctgcgtcctgatattgtgcttgagcgtttcgtatcgcagtctccggccgaacttctcctgatgccgaaatgggattgaagaatcacgagttcacacacctgatccgtcgtcgcatttcaagaacgcgatatcagacagggacggactggaaagataattccctttgctatttctacaggaagaaaccggtgtt

SEQ ID NO: 1113 - DNA (genomic), 1377 bp, PORYPHYROMONAS GINGIVALIS; double-stranded, circular
  misc_feature 1...1377
  hypothetical: NO
  anti-sense: UNKNOWN
ggctgatagagcgacaattattcgggcacgtacagatagaggaacgaggtgagaatagaaaacctcgtacatgatgggacattcgtccattgccagcacacaaatctacgcttaaatcacaggccaaaagattgcaaaggatatggagaggctgataaagaaatatacggtgtccgttgtaaatagaagaggttttattcaagatccacaataggattgtgtagttttgcatccgtcataaggtctcctatacgtcatgaacagattaagggaagcattaaaagaaaggggaattactcaaacggagctttcaactcgcttgggcaagagctttaatatggtcaatctctatgttgccaacaagcatcagccctcaattcctaccctcttccaaatagcagagattttggatatggacgtaagagatctcttggtatctaacaagcaacaaaacaaataatgaaactgatagatataacaaaaggatcggaacacgacctcagtcttttctcagacgaaaagattgccacattagagtctcgtatcactataaaggaagggaaaaaagggcctatttcctatctttcctgtctcgttcgcaagcaggagattaagcttacccccgaggaggtagtgcgtcagttatatctaatggtgcttacggaagactttggttatccactttctcgcatcaaattggagtatgaggtaaccttcggtcgggaaaagaagcgagccgacatcgtcatattcgacaagcaacaaacagatagcccttatatcatcattgaggtcaagaagccgaaactcaaggatggtaaagagcaactcaaaagctattgcaatgccactggagcacccatcggtgtatggagtaatggcaagagcatatcctattatcaccgtaaagaccctaactattttgaagacatcagcaatatcccgagagctgatcaaaaactttcagatattctttcggagcgttggacgatagcagaccttatagaaaaagataagctcattagcgaacgcaagtcgctcaaagaccttatcctcgaaatggaagacgaagtgttggcaggagctggggtggatgtgtttgaagaggtattcaaacttatcttcaccaaactttttgatgagatggagagcggacgcaacaatgagcgcaacctcgagtttcgcaactatggcgatacggagaccgaactcaaagagcgcatccaaaatctttttgataaagctcgtgacaaatgggaaggtgtattcagccccgatgccaagatacagctgacgccctctcacctttctgtctgcgtagcatcgttgcaggacgttaagctcttcaattccaatcttgatgtggtgggcgaagcc

SEQ ID NO: 1114 - DNA (genomic), 1101 bp, PORYPHYROMONAS GINGIVALIS; double-stranded, circular
  misc_feature 1...1101
  hypothetical: NO
  anti-sense: UNKNOWN
ccggcgtatatgcctaccccggtactccctctacggaaatcaccgagcatatccaaaactctcggatggctaaggaaagaaatgtccatcgggaatgggcggcaaacgaaaaaaccgctatggaatcaagctctcggcatgtcctacgcaggcaagcgcgctctcgtatgtatgaagcatgtggggatgaacgtagcagcagactgctttatgaatgctgccatcaccggtgcgaatggcggtatggtgatcgttgctgccgacgacccctctatgcactcgtctcaaaatgaacaagactctcgcgtgtatggccagtttgccatgattcctgtgatggagccatccaaccaacaggaagcttatgacatgacgcgccttgccttcgatctatccgaacgtttgggtacacccgtcatgatgcgtattacgactcgtctcgctcactctcgtgccggtgtcgttcagaccgagccgatcggagagaacgaattgcacctgccggaagacaaacgccaatatgtattgctccccggtattgctaagaaaagatacagaatcctcctcgacaagcagaccgatttcgtacgggagtccgagaactcaccctataccgaatatgtcgatgccgctgataagtccaagggtatagtggcatgcggtatcgcatacaactacctgatggaggctttcaaggctcaggtgccttatcccgttctcaaagtaacgcagtatcctatccctcacaagcagatggagcgattgctcaacgaatgcggtgacatcgtagtcatggaagaaggctatcccgtggtagaacagctactaaaaggcttccccggtttggagcggatcaaaggtcgtctcgatggcacattgccccgtgatggagagttgaatccggatcatgtggcaaaagccttcaatataccggtcgtggagggagaacctatccccgatctcgttgcggcacgtccgnccgccctgtgcaaaggctgtagccaccgcgatgtgtacgatgcgctgaacgaggttcttacagaatatcccaacggacgtgtcttctccgatatcggatgttatacgcttggtgctttgcct

SEQ ID NO: 1115 - DNA (genomic), 987 bp, PORYPHYROMONAS GINGIVALIS; double-stranded, circular
  misc_feature 1...987
  hypothetical: NO
  anti-sense: UNKNOWN
gcctccgatgtggtgaatgccgtgatcatggctcccactcgcgaactggcgcagcaaatagatcagcaagtggaagggttttcttacttcatgccggtatcggccgtagccatatacgggggtacggacggggtggcatgggagcagcaacgtcgggggatggctatgggggcggacatcgtgatagccacaccgggacgtctgatctcgcatctgaatctcggttcggccgacctctcccacgtctcctacttcgtattggacgaagccgaccgcatgctggacatgggtttcttcgatgacatcatgcagatatacaagcagctgccgagttcgtgccagacggttatgttttcggctacgatgccccccaagatccgcaagctggcagcatctattctaagggatccgatagaggtggagatcgccatcagccgtccgcccgagagcatcatgcagagcgcatacatttgtcacgaagcgcagaagctgccgatactccgcaagctcttcgagcagtcggctccgaagcgtaccattattttcgcctcggccaagctcaaagtgcgtgagctgacttccactctccgcaagatgggtttcaatgtggccgatatgcactccgatctggagcagtcccagcgcgaacaggtgatgcgcgacttcaaaaacggctatgtggatgtacttgtggccactgacatcgtagcgcgagggatcgacatcgacaacatacgcgtagtcatcaactacgacattccccacgatcccgaggactatgtacaccgtatcgggcgtactgcccgaggaacaaacggggagggtctggctatcactttcgtctccgaggaagagcagagcgacttccacaagatcgagacgtttctgggcaaatcggtctataaattgcctgtcgatctggagtttggtgaagtcccggcttacgaaccggcgaaacgtcgccctcgccgtttggggcgaagcggc

SEQ ID NO: 1116 - DNA (genomic), 591 bp, PORYPHYROMONAS GINGIVALIS; double-stranded, circular
  misc_feature 1...591
  hypothetical: NO
  anti-sense: UNKNOWN
ggctgtgaagtttatgaatagattcggggaagaattgataagaggtgtcagctggccgaagtcatatacacgctacttgctgcccattgaagggttttcattggagaaagtcgggaaaaaggggattcccatcgaactccgtcctgcatccgttcggtatcagggtgcatctgcttcgattccgaatatagccctcctttgatacacatagtgccctaaagctttttaacgtcagttcgacgtctatataataacgtgagttcgatataagcgttatggtgccgactctcataagtatttgtcgatcaatcctttgttgggttaactataaccgatcagaaaatgaaagggaaaaaatttgacgtctcatcggatgtcgaagtctcccgaagctgaaatctctcaaccgagaaatgaaatacgttgacaaacagcatattgcatgtttttcttggatcgaatccgcattgttttatagccgttcggaacatactccgaaagggggtcgagctacgccctacagcgactcgggctacgccgtanagcgtaccgagctgcgctctacggctctttcgagctacgctgaaggct

SEQ ID NO: 1117 - DNA (genomic), 694 bp, PORYPHYROMONAS GINGIVALIS; double-stranded, circular
  misc_feature 1...694
  hypothetical: NO
  anti-sense: UNKNOWN
tctaaaaggatataccgatgaagatagtaatatgcggacagctatgcagctctacccggcgatttggactggagcggtatcgaagaaatgggcgaatgcgtgttctacgaatatacccgtccggaggatttgactctgcgtgctgtcgatgctgaaatagtgcttaccaacaagactcctgtgactgcggccgacatggaaaagatgccccacctacgttacatcggactgatgattacaggccttaatcttatagatatggatgctgctcgtcagcgtggtatcaccataacgaacatcccccactatagcacagaatcagtagcccaaatggcaatctcgcatctactgcacataaccatgccgatcggagaactttcccggcaggtgaaagatggttgctggcagagcaattacgaacaaatctctcgcaatacttatcagatagaactgagcggactgacgatggctatcgtgggacttggggcaataggtacacgtgtagcggaaatggcacgtggattcggcatgaagattttggcacatacatccaaatctccaatcgagttgccttcttatatagaaaagtcccgatagcctggagaagcttttctcttcgggctgatgtgctgagtctgcattggccgctcacagtgcaaacccaaagatggttcggctgattagctggccttgt

SEQ ID NO: 1118 - DNA (genomic), 638 bp, PORYPHYROMONAS GINGIVALIS; double-stranded, circular
  misc_feature 1...638
  hypothetical: NO
  anti-sense: UNKNOWN
tccagcttacggatttggttacccgatagttcaagcgttgctaaggacgtgagacgttccagaccctccagcttacggatttggttatccaaaagataaagctccgctaacgaggtgagacgttccagaccctctagcttactgatttggttatcggagagagaaagttttgttagcgaggtgagactatccaggccctctagtttactgatctggttacttcttagacgaagctttgttaacgaagtgagacgttccagaccctctagcttactgatttggttacccgacagataaagctccgttaaggacgtgagacgttccagaccctctagtttactgatttggttatccaaaagataaagctccgctaacgaggtgagacgttccagaccctctagcttactgatttggttatcggagagagaaagttttgttagcgaggtgagactatccaggccctctagtttacggatttggttacttcttagacgaagttttgttaacgaagtaagacgttctagaccctctagcttactgatttggttatacgatagatcaagcttttttagagcaggaaaatcaataagccaagtcatgctttctatctgacattctcgcaagcaaagctcaacgac

SEQ ID NO: 1119 - DNA (genomic), 607 bp, PORYPHYROMONAS GINGIVALIS; double-stranded, circular
  misc_feature 1...607
  hypothetical: NO
  anti-sense: UNKNOWN
aagagataaagcaaattgacattgcttgttaccagcaaagcatcatacccttcttcttccattgctatacgtacacgctcttggcgtacttggagatctgccttcaaggctgcaggtgctaatttgatcataatattttgagattattttgattaacgaaacaaaagtactgaatagcatattcgcaagtcatgaataatcacgatttatcagtacagaaagctgtcttatccgattatagaaagtcttgccgatttcccgatttgcttcttctatttgcgaaaatcccgtgcaatagtcccatacagtgtgtctatgcatttgctctctttactcctgatgcactttgcaatctactcgaatgagcctcaaaagcctgctccggcgataactctccaaatccggcaaaatttattcgaccgacgaagctgtgtagcaccactcctcgactctgccatgatccgttgccaatcgctgtatggactatctccccttcagatacaatacctaatcggtttcggcaatccgttggctatactcgtctgtgtatccatggcatcaatacttaacaatcgtgccacttaactctaactatccagtctactca

SEQ ID NO: 1120 - DNA (genomic), 741 bp, PORYPHYROMONAS GINGIVALIS; double-stranded, circular
  misc_feature 1...741
  hypothetical: NO
  anti-sense: UNKNOWN
gcgatgctttcgaaagattgcctcagccggagccgattcgcagacggctggtacgcgtcggctcctctcctgttcatgaggagcgaatggttcatcagcagataggagatttgtgcgtgggcgacacggtggcacatgcgcgcttcggaataggaatcatcgaatccctcgaaggagaaggcgataatgccaaggctgaggtttcgtttcagcaggtaggacgcaaacgtctgttacttcggtttgccaagctatccaaagtggaaaaagattcgatctgaactacagtgttctgtactcaaaaacgtttaggacactattgggtgtacaccggtttgctctttgaggtattattgcttcgtgggggtatatttcccaaaagcaatcctttcttcttatctgttcaaaaccatgagactgactcagccatccatgaggtgctctaagttcaaagctaagtgtcgaacgcccttgagggtagttctgtgtacaaagatcgataaccgatatcgaatcagtcaataaccaaagatgaatcatccgagtatataacacgagggcgatgttcatcataaccggtgccccaaangtccagctccggattgtagagtggagattctattcctaagagtccattaatagcatagggcaggacatcggtcatgatgcgtcgctcctaatggattgcaatcgaggataagctccggtattggtcttcatagatggactgagatagataac

What is claimed is:

1. An isolated polynucleotide of at least 30 nucleotides, the polynucleotide comprising a contiguous sequence of at least 30 nucleotides which is identical to a contiguous sequence of at least 30 nucleotides within a sequence selected from the group consisting of SEQ. ID. NOS: 176, 192, 214, 243, 273, 417, 524, 638, 758 and 1005 and sequences complementary thereto.

2. An isolated polynucleotide as claimed in claim 1 in which the polynucleotide is at least 50 nucleotides.

3. An isolated polynucleotide as claimed in claim 2 in which the polynucleotide is at least 100 nucleotides.

4. An isolated polynucleotide as claimed in claim 2 in which the polynucleotide comprises a contiguous sequence of at least 50 nucleotides which is identical to a contiguous sequence of at least 50 nucleotides within a sequence selected from the group consisting of SEQ. ID. NOS: 176, 192, 214, 243, 273, 417, 524, 638, 758 and 1005 and sequences complementary thereto.

5. An isolated polynucleotide as claimed in claim 3 in which the polynucleotide comprises a contiguous sequence of at least 100 nucleotides which is identical to a contiguous sequence of at least 100 nucleotides within a sequence selected from the group consisting of SEQ. ID. NOS: 176, 192, 214, 243, 273, 417, 524, 638, 758 and 1005 and sequences complementary thereto.

6. An isolated polynucleotide comprising at least 30 nucleotides, the polynucleotide having a sequence which hybridises under stringent conditions to a sequence selected from the group consisting of SEQ. ID. NOS: 176, 192, 214, 243, 273, 417, 524, 638, 758 and 1005 and sequences complementary thereto.

7. An isolated polynucleotide as claimed in claim 6 in which the polynucleotide is at least 50 nucleotides.

8. An isolated polynucleotide as claimed in claim 7 in which the polynucleotide is at least 100 nucleotides.

9. An isolated polynucleotide as claimed in claim 1 in which the polynucleotide further comprises a detectable label.

10. An isolated polynucleotide as claimed in claim 6 in which the polynucleotide further comprises a detectable label.

11. An isolated polynucleotide as claimed in claim 1 in which the polynucleotide is DNA.

12. A recombinant expression vector comprising the DNA as claimed in claim 1 operably linked to a transcription regulatory element.

13. A cell comprising the recombinant expression vector of claim 12.

14. An isolated polynucleotide as claimed in claim 6 in which the polynucleotide is DNA.

15. A recombinant expression vector comprising the DNA as claimed in claim 12 operably linked to a transcription regulatory element.

16. A cell comprising the recombinant expression vector as claimed in claim 13.

17. A method for producing a *P. gingivalis* polypeptide comprising culturing the cell as claimed in claim 16 under conditions that permit expression of the polypeptide and recovering the polypeptide.

* * * * *